United States Patent 9,976,180 (METHODS FOR DETECTING A GENETIC VARIATION IN SUBJECTS WITH PARKINSONISM) - sequence listing, part 16

SEQ ID NO: 184 - DNA, 300496 bp, Homo sapiens
tcactgaattgaaaatttttatagtttttattaaagccaatgagaaagagaaacagatgaatgaaaaactatgaattcaagacctcaactcatatcttagtgctccataaatgctttagtttatgagtcaaatagtgatattttaatttcaaggtgggatcttcaaaagctttataaatattattagctgtatagctgtaactgttatcattttagcacctaactcatacaattaacctttttttctttcaaatcatcagcatattaaaatactacagtgattggttgaattctattctcaatctgttttgagtaaatgtgctaatcttaaaagaaaaaaatgatactttgtatttcttatctttcagtaattaaaacaaataatctaatcgttacatttttgctacataatttgtttttttttttttaatttgaaaacttacccctaagggggaaaaatattcttgcttcaacctttttactaagacctagccttcaagagagaattataggaaataggccattaggtgttttgaagattgcttaatgcagcagttcccagggtcttatgctgagatagtaagtacccaggggtagtattatggggtgggagaaagcatagttcatggtaaaaataggtttggaatagccttaagttaaaaagagtactgtaggcttctcagagcctttaatgggcttgtgttcatgtcaaattctttagaaaaaaactggcttaaaagtactgatcaaaagaccatagaagataaaagaaaaaaaaacatggcagaaaccaacttgagtgatgcagtcagataaaatgaaaagcagaaatgaaatgacaaccttagcctgggtgtgtagctagagagacagaaggtgaaggtcaatttcactgcattacaaataaagcctatgtctgactttcagggaaattgctgttggctttatcaaatgtctcttggagtccacttccccctctaagtagagggacctagtctctttcctgccactgcatctccagtgcctagaacagtgtctgtcacagagaaaatgctaaaacattatttatcaaatagagtgaataataaataaatgacagttaaagcataataactaaaattatataatttggagacttcaatggatggcccacttgtacaaatgaagacttccaggtgtttcctaatcctgtctctatcctgagggattatacctaaggggttttccacaggaaaagtttgcacagccttggcaacctgccactgcacgtgaaggcacagtcaagagtggttatttgtgagaaaacaataagatttgaagagagtttgactgtcctttgcacagtatatttttgctcattaaataatgttaattttaagcttaaccctaaagcttggatttttatattgatattgcctcacatttataaaatagttttcagttctcttccaaattgattagctctatcagtcatgaataaaatgacaaaatagcccattgcataaagagggaaaaaaagcaaatcatgtgaatgattttcccaaggtcccagaattattttacagaagacccaagattagaaccaaggtcttccaacttctctattcatcgtaacacacagaagagtgaacatgaattccatctggtttgagaaatcccctgacttgcagtggaatggaaactttcttttaaaaataacctctatttaaaaagaagtctacatgactaattctcttaaaataataaaacaataataagaccacataaaagtcatctaaaaagcctggtgaagagaagatcaaagatgcttatgtaacgacaagatagaagccaagcttcagaattcaaagcttttgtgagctctaatcattttgcttgcattcataaaatcttaaacattttccctctattttttgatgtataatattcaatcaattgtaatggaatgtaagtggagagggctggtaatggctcctaagcatgaaagtgaaaccatggcccatgtgcagcgctgccgcccagaggggagaggcagccttttccttcgtatccggatccttttagaaaagagatatggcctgcgactgactggtgccacttttattccttttcttataagttaattgaaatagaagggctttgttttttccccttttccactctaaagtcaaaggcactgactaggttcactgctgggctatagatgtgtgtgttctttttcaatagaattgtacatttccttataaatatatgtaatatataatatatatgtaatagatattaaagggatgggggaccattctgtgacatcctgggcaatagcattttcccagtttattgagatttttgaattgcaagtgggattaaatcttcatgactgactcacttcttatgctactgcacaaaagctgagggagttgacatttaaactcatgtgattaaacaattcataagtcttttaaaactgtacattttgacatgaaaagaatgcaaaaatattcacaagctacttagctagtgaattaggagcttttaacagaaaaagaaaataaaagaaggctttttattttttcaaagaagtggttgtatacaaccactttctcaagttttctggtatgtatttatgagattaaatgtataaaagaatgtggtgtcttcaagcagttaaataacaagctcctgttgagaaaacatcttgtagcaacaaaagagcttttaattccaaatttaataaatggagggaggggagcttttgatggtaagaaatggaaaagacagaagaaagaacatttgagggatggtggagggtaaacaaaacagcactcagcctagaaggtattcattttctgtccttaatgtaaggaaaaccataaaaacatctgcagttgaagattcagaaaattttcacagagaacattgggtttttataaacaacaaaaagagtcacatcaaaatttccttccttgaaacatttatgtaacaggaattaggaataggaatcaaaatggttttgttgtgaatagttaaggcagagagtatctgcattttgtattactgagaagatcctgtagagagtatatcccttttgtcacaaaggagagattggttcatcatgtgccatcatgggttccaggactaggacatttaaataaaggcacatgcagaacaaggttagtgaatgaagaggacaagagcagacatccagtcagttaccacgatgatagaggatggtgattgccaccaaaagtcataacgaatgttttgcatgtcacttataatttcatatatatgtgtggtattccccagccaatattcagcttatcttggttaatctctttttgtgtcttttttaaagctcctaattgaaaatgtttttgtcaagatttgttaaagaaaaaagtattctatgaaacattatgtttattaaagaaaaatacatccagccaacattgttattttcatcctagcctgagtgaaaaatcacataagcatatcacttagaggatgatttttaaacagagtctattattatttgaatgacttcactccaatccaaagcacactgggaactgtaaaatgttacagacgctatttcatcataaaggcagtgtgttatgggggaaatcattcttagctgtatgggagaagacatgactcccgacccagccactcattgaccaactatgtcgcaatgggaaaatcacttataatctgatacttttcttatctgtaaaaaaagagaagagaattattctatatgctgggactaaagagaataatgagtgaaataaggcatatgactattattatttttgttattatcagcataaataaaactcatagcactttgtagtctacaagttactttcaattgctttattctatttaattctcacagcaactctctgaaacaggttttatggtctccatttttcagatgaggaaatggagtcaaagaggtcagcacctgtgtgatatgatcaggaaaataaagtgccaggactaaaattctgattttcagatgccctacatcatgacccactaccccaaatcatttcattataaatattctagtttcatactaccttacagagtcaacaagggatgttaggcattccacatctacctgaataattccagcaattggggtaccctttcctcctgaggaaacccatctgtatgtcactattctcattttttaaaagttctcctttctcttgatccaaaatccaactctttgtaacttctgcttatatttttctatttctgtcttctaagaatgtacaaaataaatgaaattccttttcaactgaatgacttttgagttactccaaacttttatctctcttctggaaactaatcctttctaaaatacttagaggatacacttgctagtctcctcatcacaatgattttttttttaactctggaaatatattagttgtcaaaggcatctttttgttgtgtccaatatagcgcttataatattgtgtttgattttatgttaatttatctatctctcctattaaattatgtgcttcttcaaggtggagaggggatcataatatttattttttatttgtttccctgagacctaatataaaccttggaacataaaaaacctttaatattgcatgttaaattagtacactaaaatattaattgaatttaaccctaagcagcatccccaaaattgatacttaattatagaaattcaatttatagagtgaaacaggccacagttcaacttgatcatttctttagtcaaggctatgatgtaataacgggctcttaatttgcagaaaggaggtagacactgtcctccaaagctaatggtagaatctaaaaagacttcacaagagaagtgacaggccattttatctggaattggaagaaaaattatgcttttatgtaaagcaaaagcagtaagagtttaattctacaaaatacattgggactatattatgtaaagttttggaaattggaaaaaaatggctaggactttacctgctagacaatagtgacaagcaaaaattgctaagcagacaagttatgtgatattaatgatttcaaatatgtccctgaagctgacaaacccattctaaatgtttttcagctttcccaaatcgagatgacgagcacctgaataagattattgacactctgaaaggggagcagaggtgaaagtcatggacatgacaaagagggaggggaagtggtgcttttggggtgctacatgaaggttaaggacatgcaccaaataatggaaggactttactccgttaatttattcatttaacaaatatttattaaatctttactacagatatggttcctgttcttatgcagcttacagtgtagtgcaggaaagggcacgatttaaaaggaataaaagtaaggtgggatcagttgtaaattgggccagcttcacaggcactcggccagtacagtcacacaaggccgtatgctcagaagagccaagctcttggagtttaatgttctgcagtcattgtcttgaaatgtttaatacttttatctttaaatctgtgttttataattaccatccaatgagacaatggagcttgtgttggaggtttgaagcttcagctttcatgcagttctggctttcccttcctctcccacctctccaggaaggttcttagctgcctgctctctgcatcctggtgtcccaggccctgtctggccttccccttcctgccccaaccactgccaccctccaagtaagtggcaataggtctcagtagcagaaggagtcctgtcctctgccattgcctccagagggtgcctgggcatgagcacaaggacagttgagtggatgcacacctaatggcatcttgaaggcatgggggtgctggtgggagcagcgggaatccgtgcctcagagggcagtgccctggcaaattcggtaggtgacttggtgggtgcctcacatctaccctctagcaagcatgtcccagaagggggattgtaatttcctgggggtttcttatccactgtgtatggagacggtggcccatggaagggaagattgatttcccctgtgacagtcagggcttgaattcttgttttgcacaaggatctgcagacaatatagcaggccctgattataaaacagctgaagttagggacagtctataagtacctaacccggtagggagtgtggaggcctcatagtttccccagacatttaatctgagactatatctaagaactggtaagagttatccaggcagaaaggaggatgaagaaagttccagaaagaaataacatatgaaggcccagggttgaatcggagcccagaaagtgttccaggaactaagagaagttgagtgtgatgggaatggaaatggtgagcaacatggaggcaaatggcaagtcacggttagagcggaggtcagcagctctgccatacaacaaaagggcttgggaagatagctggaggagtagcaaaattaaagagtgttgtctcccagtgtttgctgtgtttaggatccatcttacctaccctgtgcctgtagagtccatttttgacatttaaataatggttgttacagtattttctgtaatatgtcatgtggctggaatgagcccatcatcctcccattgtcgaacttagatcctggatccttgtcacctatgaatgtgatgaaaagtgccctttttcctcagatttctgcaagctgcatattttgaagaaaagtgctcatcatgaaatcaaacaatcacaagtttatcttgtgcttcatcgccagcctctactgagagaaatactgtagttatttcacccaaactctccctgggagattgtgttatgcaaaagctaagtgaatggacctcaagagtgtaccaaaaaaatgtctccaagttgcaacaaagcatatttttcagaactgacataaagtcgatttttttccttagtaaggattgtttttatcacattgacatttagtttattagagctaactttataagaccagttcctaaagagctttttacctaaatctgttgccattttctatagataagatgagaaaatgctgaaaaagtatggtttttccctcaaagattattcaaaataaaatcacatcatcagttctttaccaccaggaagcggcataattacctcagactttcaaggaaacaggtatgcccagcaattggtttaatttaggcttagaattgttttcttcatccaaattgctagttcatcttctctatccttgatatactttttaatggaaaagaatctatttctattattgacttgtaagagtataattgaaaaataattagcaaggcttttacaaatgaatgcaggaaagagaaaagatatatatatatatatatatatatatatatatatatatatatatatatatatatatgtatgtatgtatatacttcaaaagtagtttccaataaatgccactagtctggtatccaataaatgccacaaaaaattagaaaagagaactaacttttgtggcacttttaacatgcaccagacaagttagatatgattattccaacttaatattcacagcatcccaatgttacccaaaagaaaatgagacagaaagggttcaataaacttgccccatctcacatgagatttactgatagagccaagccttaaattcaagtgtatcttatcgtaaattccttgtctcttctgtctcatgttaaaacattgaaaactaaactggagtagaattctgtgattgaagtataatttgcaataagaaagtcatgttatttatttagtcaataagaaagactttaaatcaatgtatttttgccttagtgtaataattattggatgcatagtgcttaactagctttatcagtatctataatatgatttgtttaaatcatgtctttaacttttgttttaagttcagggctacacgtgcaggtttgttacataggtaaattgcatgtcatgggagtttggtgtacagattattttgtcacccaggtaataagcatagtgtctgataggtagtttttgttgttgttgttgttttgttttgttttattttgttattgagatggaatctcactttgttgccaggctggaatgtagtggtgcgatctcggctcactgcaacctccgcctcccgggttcaagcgattctcctgcctcagcctcccgagcagctggtagtacaggtgtgtgctaccatgaccagctaatttttgtatttttagtagagatggggtttcaccatgttggcaaggatgatctcgatctcttgacctcgtgatctgcctgccttggcctcccaaagtgctgggattacaggcgtgagccaccgcgcccagatgatacgtagttttttttatctttaattttctcccaccttccaccctcagtaggccccagtagctgttgttccctcctttgggttcacatgtactcgtgtttagctcccacttataagtgaaaacatgtagtatttggttttctgctcctgtgttactttgcttaggataatgacctccagctccatgcatgttgctgcaaatgacatgatctcattttttatggctacatagcattctatagtggatatgtaccacattttctttatcaagtctaccaccgatggtcaattaggtagattttatgtcattgctatttgaatagtgctgcaatgaacatatgcatgcatgtgtctttagggtagaaagatttatattcttttgtgtatatatccaataatggcatgctgggtcaaatggtaattctgttttgaattccttaagaaatcaccaactgttttccacaatggctgaactaatttacattctcatcagtagtgcataaacattcccttttcttcactacctcaccagcatctgttatttgttaactttttaataatagccattctgactggtgtgagatggtatctcattgtggctttgatttgcatttctctaatgattattgatgctgaacattttttcatatgcttgttggctgcagatacgtcttttaaaaagaggctgttcgtgtccttagccaactttttcatggggttatttattgcttgttaatttgtttaagttccttatagattctggatattagatctttgtcagatgcacagtttgcaaaatatcttcttctgttctgtaggttatctgtttactctcttgatagtttcttttgctgtgcagaaactggttagttaaattaggtcctatgtgtcaacttttgtttttgttaccattgcttttggtgtcttcatcatgaagtctttgtcagggcctatgtccagaatggcacttcctaggttatcttccagagtttttatagttttaagttttacatttaagtctttaatctatgatgagttgacttttgtatatggtataaggaagggattccgttttaatctcctgcatattgctagccagttatgacagcgccatttattaacgagaaagtcctttgcccattgcttgcttttgtcacctttgaggaaaatcagatggttgtaggtgtgtggcattatttctgggtactctattctgttctattagtctatatgcctgtcgttgtaccagtaccatgtggttttggttactgtagctgtgtagtatgatttgaagatgggtaacttgatgcctccagctttgttctttttgcttaggattaccttggctacttgggctcttttttgcttccaagtgaattttaaaatagttcttttctaattctgtgaagaatgtcattggtattttgataaagaatagcattgaatctgtaatttgctttgggcagtatggccattttaaccatattaattcttcctagccacgagcatggaaagtttttccatttgttgtggcatctctgatttctttgagcagtgttttgtaattctcattgtagaactctttcaccttcctggttagctgtatttttagatattttattcttttggtggctattgtgaataagattgcattcttgatttggttgtcagcttggatgttgttggtgtataggaatgctggcaattgttgtacattgatttgtatcctgaaactttgctgaagttgtttatcagatcacggaacttttgggcagagactatggggttttctaggtatagaatcatataacctgcaaacagagatagtttgacttcctctcttcctatttaaatgacttttatctcttcctcttacctggtttctctgcctaggacttccaattctatgttggataggagtggtgtgagttttgtcttgtgctagttttcaaggggaaagcttccagccttttccattcagtatgatgttggccactggtttatcatagatgacacttactgttttgaggtatattccttcaatgcctagtttgttgagggttttttacgtaaagggatgttggattttattgaaagccttttctgcatctatggagatgatcatgtggtttttgctttttgttctctttatgtgatgaatcacatctattgttttgtgtatgatgaaccaaccttgcatcccagtataaagcctactttattgtgatggattagctttttgatgtgttgctggatttggtttgctagtttttgttgaggatttttgcgtctatgttcatcaaagatactggcctgaagctttctttttttattgtgtctgtgccaggttttggaaacaggatgatgctggcctcatagaatgagttaggaaggagtgcctcctcctgaatttttggaatagtttcagtaagaatgataccacctcttctttatacattgggagaattcagctgtgaatttgtctggttctggactttttctagttggtatgctttttattactgattcaatttcagaactgattattgatctctttagggattcaatttcttcctggttcaatggaggtcatatatttccaagaatttaatcatttgttctagattttctagcttgtgtgcatagaggtgtccatagtagcctctgacttttttttgtaactctgtggggttggttacaatatctcttttatcatttttgattgtgtttatttggatcttttcttatttttttcatatcagtttaactaatgatctatcagtcttatttattccatgcaacaaccaactcctgaattcattgatcttttgtatgttttttcacatcttgttttttgagctttttgttttgttttgttttgtttttagttgtcctttgattttggttatatcttatcttctactcgctttggggttggtttgctcttctttctctagttccactaggtatgatgttaggttgtagatttgagatttttctaacttttaatgtgggcagttagcactataaacttctgtcttaacactttcttaactgtgtcctagagattttgttatgttgtatctttgttctcgttagtttcaaagaatttcttcatttctgccttaatttcattgctaacccaaaagtcattcaagagcaagttgtttaattcgcatgtgatttcatagttttgagcaattttcttactgttgatttctatttttattgtgttgtgatctgagagtgtggtgagtataattttttttgaatttgctaaggattgttttatggccaattgtggggtcaattttagagtatgtggcctgtgcagatgaaaagaatgtatattctgtggttttaggtggagagttttgtagatgtttttaagtccatttggtcaagtgttgtgttcaggtcataaatatccttgtaagttttctgtcttgataatatgtctaatactgtaagtagagtgtttaagtcttctactatattatatggttatctaagtctctttgtaggtctctaagaactttctttaggaatctgggtgctcctatactggatgcatatatatttaggatagttaggtcttcttgcaaatcgaaccctttaccattatgtaataccctttaatttttaaaatatctttgttggcttaaagtctgtttggcttaaaatctattttgtctgaaattagtatactaatccttgctttcttctgttttccatttgcctggtagatttttcttcatccctttactttgagcctatgggtgtcattgcatgtgagatggggtctcttgaaggtagcataccattgggtcttgcttctttatctaactcaccactctgccttttgattggagcatttagcccatttatattcaaggttaatattgatatgtgtaaatttcattccttcatcatgttgttagttggttactatgcagacttaattgcatggttgctttacagtgttaatagtctatgtacttaagtgtgttttcaaagtggctggtaatggtctttcctttccatatttagcactctgttcaggacctctcataaggcagttctggtggtaatgaattcccttagcatttgcttgtctgaaaaggaccttatttctcctttgtttatgaagcttagtttagctggatatgaaattctgggtaggagtttctcttctttaggaatgctgaatcaaggccctcagtgtcttctggtttgtagggcttttgctgaaaggtccgtggttagactgatggggttcccttggaaggtgtccttccccttctccctagctgactttgggaatctgtttactatgtgtcttggagatggtcatcttctgtagtaccttgaaggggttctttgcatttcctgaatttgaatgttgccctctctagtgaggttggggaaattctcatggaccatatcctgaaatatgcttccaagttacttgctttctctccttctctttcataagtgccaataagtcatagatttggccactttacataatcccgtattgcttagaaatattgcttattctttaatcttcttactttatttttgtccagctacgttattttggaaaactggtcttcaagctctgacattctttccccaccttggtcaaccatatccatgcagaactatggtaaagattacataccaaaaatcagaacaatttccatttaccgaatgctgaccatcatattatgctcgacattcatgaatatcctctgttgtggaaagcaatagtgcagtttgaaaaaaaaaatcaatgctgctacctgagggaaaggcaagtgagatggactttgaaagggaaaagagaaagtgaacccaaaggtccaaggtcaagtataccctccaacagatcagagaaaagatgaaaatacagaatgagtaaggttgtgtgaaatttaatgaagaaagaaagcaaaattgcagtagcaatagtatcacaagaataacccataagtgtgagtgtacctgcattcaccctgagatgcacaccaaacccaaacttcccttctcccaactaaataatcacaagttctttatctgcctccaattagatgctgaaggatagagaaaaaagcaaagaaaagtctaaagttcaaaacataatgcacaaaacattttatgactgcttactacttgctgtatcctggtgataaagagaagcagtagaaagaaaatcacactaggaaaagagatctgagagttgaaaggcagcttcccagaatcaagccaagtatatgttttcatgttatttgtgttgcatgcttccactttaagtcataggtacttgcatgtcaaaggtactctgtaagcactaagtgaatcaaacagaatgaaaggggagagggaagatgagattcatttagaagaagaaataagaaggcaatttacttttgcataggtgggaacatagttcagggctctttacactggctaaaaaggaagaaaaataataaagagagaagggttgccaatcacacaaatgtaaatgttcaaagatatatgagatttgaggtggaagatgtatgatcgtatgtgtgatttcctcagtgacaggaaatatcagatttatgaatatactatgctccattttcatctgtaagaggaatttgaaaaggaaatattattttgggtcatgacttgtcttctgcatataataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagattctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgtttttaaaaatgaaaataaaaatctcagtgcaaagaatacatttacttctctagtagactattaattgcagaatcgcaatacatatgatctccttcttctttgttaaccaagtctcaatcacatttggttaacaaataaaatactacactccccgtcatcccttgtagcgaaatgagcttataagtctaagtcctgcccagtgagatgtaagcttactattttgtgacagtctttctgggaaggctgcttaaagggagccaataagtcaaggagaaaggataatcgtttatccttccccacctcttcctgctacaacagaagggatggctggagctatagcagccaatttagactatagataaactcaaagaaggaagctccatgctaaaaatggaatataggaagaaatagactgtatcaccgataacgtcctcgtgccaccagaatgatttatcttcaaacttctcttttaactgaaaaaaaaagtaaacttctgttttgattaagccactctcattttcattattatttccttccctggttatacacatttaaagcttattccaactgatttagtacttggaagtaagtttcttcaagtatcagaaactaaaatgtggcactaaatgtgtaatggaagcagagctgcataggtgcatagcaatgactcagataatgaaagccaaaaatctcatgatctttataataaatctacaaaatatttagtcaagtcatcacctgctacacattggaagccaaccacatgctgccaaaggctacatatagtattaggagaaatggtaaaatattggtatgggttgtcagaaaaatcctagcatgacaaattcgaggtggaactaactacctggccagtctcagagttgaaacggaaagacatgcacctttgctaaggaaggtactctttgcctgtaacccacaatctcagttgactgagagtctggtaatttgaaaactttcatggttgaaaaagccaactgcctataccccaaattgaaacagttaaaagaagcgtctgaaaattctaggcttagcgataaatatgacttttgccacaccatacaaaagttgtgagcctgctggcaaagataatgcattacttcatatgttctcaatgcagcagacagcaagctgaaaattatttagatgcacagagcacagaggtctgtaaataaaagaccagggtcttcaagcttaataattccatttacccaaggtcattgactgtttattcacacttggagatgaccaaaaaacaactacgctgaaagtctgtcatactttttagggtatcttattgtccaaaactaatccagtgggtcatgaacccgtactaaaaggaagtggcttgctacatatgtgcagtccttagtgaagatattctcctgaatgtccatttcagatgtggccacagaggacaacagaaaaggaagaccctcctgaagagcaaatccaggggccacgaaagaaaatgaacaagagaatttttattgaagagcagaacctgggactgccagatggaccaactaaagaactcacttcacaactagggcagtgagtcctcaccatttcttctcagcaagagttggctgctgtaaaatcagagagattattcatgccttatggttaataaaagtatctataggtaactgaaccttgaggagccaaattgaggcctgatgaaggagactgtacatcatccagagagaatgaacttggagcaggatgcaaagactgcaggggagaaatcagggtttttctgctggaggaagaagcagagggtacatagacataaggtatccaaagaagcccactatagaagctgggacagattgcatacttattctcaattcttcactcctccctatgcagtagagcagagaaaatcgagtatacctgtgacttgctttgaccagtggaaagttagaggggacaagagcacaggctttaaacatgcccatatgggacttctgtgcctaccatgagaacatgccccataattgttaatgcagggagaatgaggagatgtggtgcagactcttagccaatcccaagagctgggttcaagggtagccaacactcatcctagagaagtgtcccctctgacctgcagacacatggccaagaaaaatcaatgcatgttgttgtaaaccattgcatttcaaggctgtttgtgatgcagcatcctggctaataaaccagccaggtctattctaacaattgtagctcagagtaaagaatgtgggcatctcatcagcagacatgatcactaaaaagacagagaaaagatacaatgagaaaactataagcaaactcttggaaatccaacgaacaaaatagaagaaagaagaaagattaagaaatttctagaaacatcctacagtggtcgggaagactgagatattaagcctaggagataaaaatggacaggcagattcatatcatgcttaaaaagaaactgcaaatgattgagaagttttttttaaagtggaactatttcaaaagtaagaaattagtaaagggacaaagttgttaatgcaccataaacaagtgatcaaaagcagaaaaaaaaatgaactgctgtggaaatggacacagtgtgatcctatttttagtggactacttgagttttttaaaaaattaggaggaaggtaaaaggttcagaaaatagaaacagaagtgtaaataatactatgaaatgggcctagctgaaacagctcacttttcaaaagaatacattaaatgaagaatacagaatgagatccttaaaaaaagaagtcaggaaagtattacatagagtaactgcaaaggccttctctccttataacacggaaattgatgtatttgagaataagggtattaaaaaagatctttaagagtctacaggaaatagaagagctaggacaaagcatggatgtcatgtagaatattttatgataaactgctgacctgagccaataattcttgggctggggaaaaaaactgtttctctatagataggtgggtgggggtgagggtggggagggaaaattgtaatgcttactttctaaatagatttcaaaggaatgcgggagaacacaaagagaactagcttgcattgttttttttaatattagcattttgttgataaaacagaaagcaggaagaaaaataatgaatcatgcatatagtaataaaaaagtgtggtaggtgattaacgtgttaagagtcaagggaagaactcatcagaagagtaaaagaagagaactgaaaagcaaagggggacaatcaacaaaatgtgaacatacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtgcaatactgagcgctactccttgaaggtgaacaacatagaaatattgttcagtgcaactcaacaaatgtttatttaacgactgcaatgtactgagcaaattttaggctctggtaagacacatcagtaatgaagacaaacatatgcattaactatatcaagcaggacaaagggctctaaagagaatgaatgcagttctccaaacagagatctctgctgtcactattgaatatcttgtaaactctccagaaacgtgtatgtgcaagcatgtgtctgtttgtgcatatatatatatgtgtatattttaatgctacacatttgaagataccttattacactattcatgactttgtgattttctcttaacacagcaatttggagattaccccctttcagaacatagagagagctacttcatttctcccaatagcatattttattgcatggttgtgccataatttattgaattactggcctttaatgaacaattatgccatttccagtcctttcttattcatgtaatgcttattcatactgtgctttacatatgggctaatatacctgttaacacaaatcttgagaagtgaaatttctgtcacccggcaagtgaatttttaattttgatacatagtgccaaatagccttcaaagtgaaacattcacttatattcccaccaacagtgcacaaaattgcttttgtcctcaaacttcctgccaatgccatttattatcaaaccatttgatccttgcaagtacagtaactaagaagctatctcattgctgtttgaattacaaactacaaatctcattgtagtttaaaatacaaaccataatggtcttattatgagcaaatatgagtaggtttttacatatttaaaactcttttgagtttctcttactgtgaattatctgtctataatcttggcctatttttaaaaattaataagttagaagaaatgagccaattttcatatatcttggcaggtttttccagtttcttattttccattcaaatttatttatggttgttttaaaccattttgacattttgatctttttttaattttgagattattgtagatttatttgcagttttaagaaataatacagagagaattccatatacctttcaccattttccctcactggtaacgttttgcataactacaggacaatgtcacaagtaggaagttgacactgacacaatgcatctaccttattcagatgtcagatttacattcacttgtgtgtgtgtgttagttctacacaatgttgtcacagtgcaatttcctgtgtgcactactgtggtcgagatacagacttgtgtttcatcgcaaggattcccttgctacccttttctattcacagtccctccttaagccctgacaagcacacatctgttctccatctctataacttggtcacttcaaaaatgaatggaatcatggagtctgaatggaatcatggagtatgcaatattctgagattggctttttccactcagtgtaattgtcctgcatttgtaaaaaaattggcatttcgaattttggtactatgctatttagcttaaggttcataccaaactttaattgtagatttaaactttttcattgtctttcgtttggtagtttcatgcagttttccctaaagtggaccttgtataattttaataaaattactcttgcttgcttttagttttaatttgtttacctatattttgcttcctgcctttattgattttagatgaatatcataatagcacctgtgtcattttgtggtccaaattggtggtcttttaatgagcaattttatctcattgatatttactgatatggcaattagctgtggcattttatttcaagttctactttctgtatttaatgccatttatttttgctatattgtctatatttcttgtatttgcatgttttacttttataatttggaaagcatattctcttcttcagattttctggtagtaacataatatacacataatatacacatataaatatatatgtatacatttaaagaaaggacatgagaaatgcacatacaattctgcaaaagaacaaatagaaaaaaggtaagaacacatcaaaatatttagtcgtaaaagacatgaaaattataagaaaacccttctctgagaattcaaagaaattttttaaaaagtcttctgatacatatatatgtatatatgtatgtgtatatatgtacacatatgtgtatatatgtgtatacatacatgcatatatgtatgtgtatatacatgtgtgagtatatatacatgtatgtagtatatatacatgcatatatatgtatgtgtatatatacacatatctatgtatatatgtatatgtatatgcatgtatatatgtacatatatatacacatatatatgtatcagaagactttaaaaaattttctttgaattctcagagaagggttttcttattttcatgtcttttatgactaaatatttttgatgcgttcttaccttttttctatttgttcttttgcagaattgtatctgcatttctcatgtgctttctttctgtttgtctttgttatttttgttgtttttccccaggccaactatgcattagaggataatgttagaaagcacatcagtggagtgagttagatattcaggtagcttgcattcaaatttgtgtcttgaaatgtttcccaacaaaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccaccttctctgacattcttttctgcccagcaaggttagtgatgccccagactctgacacagcagctaagcgcttgctgttccaaagtggccctgatgacatttcagaaagtgtaacttacctttggataattctgcgtgctttctgtgaacatggaggcacacacctcctgctgctttcctcattttaactagatttaaatttcataacacttttacagccctccaggttttcatttctgcttctttgttctctgttttggttttaagttggtttcaaagaacggggcagaaatgtctttactctgccatctttaattggttcctgtactctttaatacattttaaaattaaagccagagaaagaataattaaacttccatgctgcaacccatagaagttccaatttcttgtgtatacagactctctctctctgcatttttaagaagttccatacacttttaggaagacttactgtcttctccaccaacctgagacacgtacccctacaagggtacatgaaattccactcaacattctgtgagttcacaccaaagattcataaggctacacattgttccttctatcattttctaaaaggattttcttctcatattttcttgtatggttataaataacatgttcctgttcacagtttgtatttagaacatttgctaggcattttgttttcaatcataatccttagagccttgaaacaaacaaatcacatatactgtatagaatgatatctgcttggtatttctgccttaggaaataatgttcatttttgaggcttcattttaatgtacagcagaatttagtgatatcacaatcccctacacagttctagtaaaactaaatgaaacagtgtgaagctcctagctttatctgaactcccatgtctgaaatctgtcatttgttggtgtttagtttgcctggaatgtttgtttacctactgcctgttgactagcttccaaatcctcttgatgagttgatttcataacagctgaaaataacattgcattcctcacctgtaacaggtggtccccaagtggctgtccatcttcccttgtgttctctgctgtgaactgtaaatcatgtcaagaaacgacaacccattagatgacatgatctaccatcactgcgaggagccacccgtcacaacatgcacacactttatccatcctatgcgcaaataataaatttggtcaaaagattgccatttcatgttctggaaaacatgaacttatgtgagcttatacataaaatattttaatctataatctcatgtatatgtcattatgtcatatttcccagaattcagctgccaaaaataacattaaagaagtagttcatgtcaggtaagatgagaatgccccataaatactgattctgaacctctagcagccatacatatgttaattcattattccacaaatattttgtgcacatattctgtgccaaacactgtgctaggtccgaagaataccaaaattaatcattacaaactcagagtccaaagaaaaaggcagactcacaaataaacagctgtaaaaatgtgtgttgctctatttggaggtattacgtagacattagggagagagcatctgtattagtccattttcacactgctgataaagacatatccgagactgggcaatttacaaaagaaagaggtttattggactcacagtgccacgtggctgaggaggcctcaccatcatggcagaaggtaaaaggcaaggagaagcaagtcacatcttaacatgaatagcggcaggcaaaagagcttgtgcggggaacctccaccttataaagccatcagatcttgggagacttattcactatcacgataatagcacaggaaagtcctgcccccatgattcaattacctaccaccaggtccctcccacaacttgtgggaattcaagataagatttgggtggggacacagccaaaccacatcattctgccccagcccctcccaaatcttatgtcctcacatttaaaaaccagtcatgccttcccaatggtccccctaagtcttaactcatttcagcattaactcaaaagtccacagtccaaagtctcgttcgagacaaggcaagttccttccacctatgagcctgtgaaatcaaaagcaggttagttacttcctagatacagcagtggtacaagcattgggtaaatacagccattccaatagggagaaattggccaaaacaaaagggctacggaccccatgcaaatctgaaacccagcaggacagtcaaatcttaaagctccaaaatgatctcctttgatcccatgtcttgcatccaggtcaggctgatgcaagatgtgggttcccatggtcttgggcagctctgcccctgaggctgtgcaggatgcagcctcccctccctgctggctgctttcatgggctgccattgagtgtttgtggcttttcctggtccacagtgcaagctgtcagtggatctcccactctggggtctggaggatggtggccctcttctcatagctccacgaggtggtgccccagtagggactctgtgtgggggctccaaccccacatttactttctgcattgccctagtagaggttttccatgagaggcctgcccctgcagcaaacttttgcctggacatccaggcatttccatatagcctctgaaatctaggcagaggttcccaaaccccaattcttaacgtctgtgcaccaccaggctcaacatcaggtaaaagctgccaaggcttgaggcttgcaccctctgcagccatggcctgagctctacattgacacctttcagccatggctggagcagctgggatgcaagacaccaagtccctaggctgcacacagcatggagaccccagattcgacccactaaaccatttttccttctagacctcctggcctgtgatgggaggggctgctgtgaagacctctgacatgccctggagacagtttccccattgtcttagagattaacatttggctacttgttacacaaatttctgcagctggcttggatttctcctcagaaaatgggattttcttttctatcacattgtcaggctgcaaattttccaaacttttattctctacttcccttataaaactgaatgcctttaacaacacccaagtcacctcttgaatgctttgctgcttaaaaattttttctaccagatatcctaaatcatctctagcaagttcaaagttccacaaatctctagggcagcaacaaaatgctgccagtctctttgctaaaacataacaagaatcacctttgctccagttcccaacaagttcatttccatctgagaccaactcagcctggactttattgtccatatcattatcagcattttggtcaaagccattcaagaagtctctaggaagtttcaaactttcccacattttcctgtcttctgagtcctccaaacggttccatccaatctcttcctgttacccagttccaaagtcacttccacatttttgggtatcttttcagcagtgccacacttcccataccaattcactgtattagcccattttcacactgctgataaagacacacctgagactcagcaatttgcaaaagaaagaggtattggacttacagttgaacatggctggggaggcctcataatcatggcagaaggtgaaaggcaagaaggagcaagtcacaatcttacatggagggggtcaggcaaaaaaagcttgtgcagggaaactccaccttataaagccatcagatcttgtgagacttattcactatcctaaaaacagcatgagaaagccctgcccccatgattcagttacctaccaccaggtcactcccacaacatctgggaattcaagatgagatttgtgtgagaacacagccaaaccctatcagcttcattctggggtcaggtggtagggacaacacaaacaccaagataagttcctttggagatatggcatgagctgaggcttataggatgaataagaagtatgcttggtaaaagagttcaggcaggaaggcattggggagtggcatttcttggtaaaggagttcaggcaggaacacattggggagtggcatttattgtataggggaaggagcaaaggtatagagttgagaaggaggttagaacacgcaaggaactacgagcaatactacaggagtttacttagtgatgctggggccagtgagatatgtggagcagtaagcaaaaggcaaggttgaggagcactccaggaacagtacgtaggaagccaggctggatcctgtggtcaggagcttctgaagagcttgctgttgtggatatttgcttgcacttaaataacttttgtattagtctgttttcacactactgataaagacacacccaacactgggtaatttataaagaaaaagaggttgaatggactcacaggtccacatggctgtggggggcctcacaatcatggtggaaggtgaaagccatgtcttacatggtggcaggcaagagaggatgagcgccaagcaaaaggagaaaccccctataaaaccatcagatttcatgagactttttcactaccatatgaacagtatgggggacaccgcccccatgattcaattatctcccaccaggtccctcccacaatacatgggaattatgggagctaaaattcaagatgatatttgggtggggacacagacaaattatataagctttattgaggtttaatttacatcttaagattcacttaggtgaacaattcaatgattactattaaattgacagagttgtacaatccttaacacaatacaggttttagaatatttccatcattccagaatatccctcatagccatttatagtcactactgactcctacctccaagaaccaggcaaatgctcatctgctttctatgtctatagatttgtcatttctggacatttcacataaatggaatcatagaatatgtagtcatttgcatctggtttgtttcatcaggcatcaggtttttttagatttacccacgctgcagtatgtatccatagcatatttgtttgtattgtaaaatagtattccatggtatggatataacatcattggcttatcttttcaccaattgatgggcgttcagattgtttctattttttggttaatatgactaatgctgccacaagcattcacatgcaagtctttacacagacatgttttcatttctcttgggtagatatttagggatagaattcttgggtcatatggtaaatttatgcttatctgcttaagaaattgtcaagctattgtgaaaagcagctgcatgattttacaatcccatcaacaatgtctagggttctagtttctcctaaggagttttaacgagacggataatatggctagatttgtgctttaggtaaatcaatctgatagctactaaaaatgagactgaaaataatgagcctgtttaggaagatgttacaataatctaggtgagatctctactacgattcccaactagaccattggaggagaagattatctcagaagaagaacaatgctgctgaataagaacaggtgatttgcttccatcagttgctcagccttgggaacgtgacttaccgtggtgtgaggacaaagcaggtacctgcccgccagccagattagctgaggaaaatacacttcaggtatgtaagcttatgccttcacatctgaaatgtcctgtactaacatatacaccctcaaactttccaacacttatactatcactgtgtcattttttcctggttcaccaactgcatactggacacagtgctgcacatgctattgggtatttttcctactttagagattatgttcatttggttctaaggataattgcaagaatattgttgtgctataagtaaataaatgctatgtatttataaattatgtgttaaaattatactatttctattgttagcacacacagtattaagtcatgtggcccaaatctcatatttcatagcatattatggttttattaggatacagtaaattaatatttcagtgagaaagtatttggaagtacccataagccttatcaacagctcatcccaatgtttcccttcaaacagccacgtggaatttgtgtaaatgagtctaaatgaatgataaggacaatatgatgtttgagttaaaatatcttttgaaactgaaaatgagcagctagccaaaaaaaatctgtcactttaaaaagatcaggaaaaagtcttaattctgccattgtgcaatgtatagcatgtaactaagaacaatatctaaggacaacaaatataaatattgaaggaagttgagtaatatttaattagattatactatatttggtctaggaataataaacctgtaaaattatctacactatgaaactaagctctgtattataacatataaatgagttctctgatcttttaaaatatgtatttctaacaaccttgtaaatgattaatatttcaaaatactgctactactgctgctactactagtaataacaacaattttgaatagccttgaatgtcttaaaagttgtaaaatataattttattcatgatgattaagttccatgtgaataagagaaataaaatgactacaaatatttaaccaaaaataaaagaacagagggtttgtcaaaagagaccaatttacttattaaatagaatgaccatacattacagtttcctggaatgaaacacttttataactattgtcctgatggccaatccagtttagcattttgtccttgattgctttacctttcaacaaagtattattatcaatgttatgattattgttatcattaatgaaaataagccagatggacttttacaacctctacttcatactcccaatctttgttataatcatgtctaagtagcacgagacaaattcagggaatgcagttctcaccttaaatgggagttaatcttaaagaagaccagcagtaataacctatctcttcccatttcagactcaacgtaaccaatacctgcctttcaaggaaaactcatatggggctcactgacgaaacaaagcgagtttgcaaaaaaagatttgacatagtcaattctttgtactcttcagtgatggcagctgccttagtggaaaatgtgggaaattacagattggggtaggtgaattgaagataaaattatttatttttgttgttataaatacaaattttgatataatatagcatcatgtgtaaaacaattttcctaacttaagaaatatgtggaacagaaatatttgaaatgtggtggtgtacaaggaagtgagcttgaagaaaagagggtcccaaaaattcacgttttacaccaagagaaataaaaccgtagtagtcacaatttatgaatatttttacacttgtatatatatacttgtgtatttgtgtgtatacgtatttgcaactgaattataaactttaatgattaagctgatttgaaataattttaggaaatactttagtatggcaatacatacttggtctttttgttgcccataatcaattagatttgagaaataattaacctttgaataacctctttgcaaatttacttagttatcctagcaaagtattaaatattttgtaaatgagtcctgacatttctgattgtatgtttttcaaaattgttggaaatctttaaacaaaatcctggagcatccaaatttcaactactaaagattataattttttgagcacccatatttcaaatatgaaagcttttggcaaattgcatttattgaaaataaagctttcatacaggaagatattgatagctcttaaaaagcaagggatacattgaattgattagatgataagtgggcaaatggtatggaggatgtaattttaaaattctctaagagcatattgaaatgtattaacttttaggaagaattttgatgagcccctatttttcagtaaatttctttttaaacttgtattacattttattttgtctctattttttgttattattattatactttaaagttctggggtacatgtgcagaatgttcaggtttgttacataggtatacatgtgccatagtggtttgctgcacccatcaacccatcatttacattaggtatttctcctaatgctatccctcccctagcctcccacccaccaacaggcccaggtgtgtgatatttccctccctgtgtccatgtgttctcattgctcaactcccacttatgagtgagaacatgcggtgtttggttttctgttcttgtgataatttgctgagaatgacagtgtccagcgtcatccatgttcctgcaaaatacatgaactcatccttttctatggctgcatagtattccatggtgtatattgccacattttctttatccagtctatcattgatgggcatttgggttacctccaagtctttgctattgtgaacagtgctgcaataaacatacatgtgcatgtgtctttatagcagcatgatttataatcctttgggtaaatacccagtaatgggattgctgggtcaaatggtatttccagttctagatccttgaggaatcaccacactgttttccacaatggttgaactaatttatattatgtaccattatagaatgaaaatgaagtcaatgatttgatggtaaagagctgcatataatatgactaatactaaaataataaataattttataagaactgaggtataggcccaccagcataatcaatctaattataactatttcaaaaattctattattctaattattcaactatctgcatttactatcaaaaatgcttcagcttgagaataaatgatatgatcatcccagttttgatcaagtaactattggtggacacttttgtgcaactagatcctaaaataataaaagcctcttttcttcatcatgatagaaataaaaattcctctttccaagtgtctctttatgctcatcctacaggaaattcaattaaagatattatacaatactggatgttaaggctctcaatcaaatgttgccatttatttcattaaattgtcttcgtaacaggctaattaaattattgcccagtttagaatgtaatttctatagcttatacaaccaaacttaatatccttaataattcaaaaacagctatatttttatacttgaaaattgtttctgcatgttgaagattacagatttgcaaatgttctggcaagtgtgagcctctttgaaagtagatcatatccttaaatgaatagcaaataaatcacagccacaaaattgcgtatattgcattttgcaactgatagcctcttagctgctcagactgttatttaaataaaatgaataattagagcagaaaactgaagagaaggtgttatttttatctctgtactcaatagaatgttttcaagacaaaaattagtaaggagcatgcttgctcaatttctttaactttaaatcaatgtttactctctgaacacttatattgtaaatgttaagtagaggcttagaaactgataatactaataataaaaaatgaaaaattgagtaggctatccagttatttgccaatgtttaaaagctatttggcatattattggcacaatttagctgacataactcaggtgcttaatttcattaatttcaagatagtcaaaacatttggcatgaagattaaaggaaactcaaaatataaacagaattaaaataacatcataaaaatagtagttgccgaaataatgaaaaaagtgttaatagcaataaattaaggcacacatcaatcaatatgaaaacatactataaatgatgtgaacaaaagatacaagttaaagaggcaaacagtcaataaatatgcgaaaaattaaactcacaaataaataaatgcaaattaaagtataagcataatgaaatttttgctctccaaattaacaaataatttattatctcatttctctctgtggacaagaatatgaaaaagatattctgataacctcctggtgaggcagcaatttagtataattttttgaaaagtaatttaaggccaggcgcagtggctcatgcctgtaatcccagcactttgggaggccgaggtgggtggatcatgaggtcaggagatcgagaccatcctggctaacatggtgaaaccccgtctttactaaaaattaaaaaaaaaatgagccgtgcgtggtggcaggtgcctgtagtcccagctacttgggaggctgaggcaggagaatggcatgaacctgggaggcggagcttgcagtgagccgagatcgcactactgcaccccagcctgggtgacagtgcaaccctccatctcaaaaaaaaaaaaaaaaaagaaagaaaagtaattttaaaatacatattaataaagatattatacagtatctttgtatgtctttgaccatatgtctatttattttaaaaatccatccctaattatcagaaatgtgaacaaagatttatgcatagtgattttaccgctttttagttataaaaataaatcctgagtatgacctaaatgtacagcaatagagtaatagtttaattaagatgtattcatagaatgtaaaaagtattcaatgatatgaaacttctttatttttaagtgaaaaatgatggcaaaaatatatacctccaatgtatctatgtctgtgtctatctaaatatgttcatctatcaatgtatctgtaaccctttatgtttacaaaattaaaacttagaagactatatctcaaaatgtcatttcttatttgcatcactgttttgacaatgaaaatgtatatttcctttacaatttgagagacattttacaaaaaaattagtccaaattttgtttaaaatgttaagagcagcataagttttgtaggactttaaagtaagaaagtaaattaaggtttttcataagatagcaattaactggtcattttaatctaaccagtaaatttgaattaatttgctgctaatgggtttgctttagtttaaaagtatatggagtgccttagactcttcaggctactataataatataccataaactgggtagtttatacacaacagaaatttatttctcacaggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagataccacctcctgattcgattatcttcatggttaagatttcaacacatgaacttggaggaacacaaacattcagatcatagcatggactatttgttattagtattattattatttcttaattacaagtttaattaaaggaaccaatagctagggaatacagccaagtttgtttacaagtatgaagaaccaccagtgctacaatcacaaaaaataatctatgaaaccactgttgaaaatatttttatgttatattgcaaaaatcactgaatttataccagtgtttatggcaatatttgcccaatttacaatcggaattatgttggtacttttttatatgtcaaagagaatacaaaagtcgctttgtccttataaaatataatcggtagattaaattttaagctcactgaagtacaaataagctatctagatagtataaaaactagttagaaaaaaatttcaaacaaactgttggtttgagtttttttcttcacagtatataaacatttaaataaaaaactttaaaataaacttcacacccagttttctcatgtttaagaaagtcagtacaaagtagtagttaataaagctggataagaagcagattacctggaactaagttctgctctggcacttataaattgtattatttagggcaagttatttaacttctctgttcttcagtatcctcatcaccaaactgggaataataattgtatctacattaagggattattttaaagatacaaagagctaataaaatgtaaagcacataaaagagtacccaggacacagtaagagcttaatcaatactaaccttaattattgtgccctcagtctacactcatacttttcacagcaaatcttgagtgaatagtatttactttttttcattcatttcagaagcatttgttgagtacctaacaatatttgtaattttgaaggcaaatgttggataagccctggtggggaaaaaagacaaatgtaacctattctgacctcaaataatgcatggcttcatgatagagagaaggatcctataaaaaaaaacaaacaaaccaaaaaagttttggaagtacagaaatgtactggctgcagaggagcaggcaagacatagaatctaggcagggggttgggattaggaagggctagtctctgggaaaatcattcatgctctggggttcaaacaatgcattgaattgtcttgaaaaataaagtgaaatagatatacgggggaaaaataatccacacaggcacagatgcaaaagagattgtgatgcatttgaggaaatggaagaaaactgatttggctaagttcaggatacaggtgggaaagagaattgtgaaaattgtggctgtataactaaggagaggtcagattatgaagagccttcaagtagagtaaacgtataatttattgttgtaccaaactatctttgcaagtgagggggagaatactaattattttacccagaacacaagcataaaacaaaaatctccatagtgacttggaatgtatagtacttctaggccatgattactttcatctatgcatctatgttctctccatctttttttttttctttttttgagacagaatcttactctgttgccgaggctggagtgcagtggtaagatcacagctgactgcaaccttgaccttctggactcaagcaattctcccacctcagccttgcaagtagctgggactacaggcacatgctgcgacacctagatatgcatttaattttttgtagatatggggactcaccatattgcacaggttgttcttgaacccctgtgctcaagtgatcctcctgtctcagcctcccaaagtggtggtgttacaggcatgagctacagtgcccattggcatcattttacctttaccttgggtacatgtatgtgttgcataagggagcagggagcacagggagaggagaatctcacaggcaagggggttctggtaccagataaaggagatagatacaaagataagccaaaccacaaatgcttattcagcattcttcctgaactatctttcctcccctgaaactcctttttctttgttttcttcttgtgtctttgattacttttttcaatttcctccatggggttctcttttttaatacgaatttttttctttgcttattttcttttctctaactgtatgtagagagatatgaaggcaaacataaccctccctacagtgtcaatttcaatcttattttaatggttcctgaatgtttctcttggtactgaaaccagcccaacttcctcacagaactgatgtttatagtttttagataaacataaaaattgactcaaccaatcttaaaatgtaaaacttaaatttgccttatctgagttcctttctcaggaaacccactctcaggactcccaaataatccataagtatctctgagtgacttttaggtgcccagtaactatagcctttttcacaaatcagggtctcatatctaatgctgggtccagtaagagactttaaacttcatcttaggccctccaatatgactataatatttgcatgtcactaaaatattgtggtgttaggaaggaagaaggacaagagaaaaattcaaagaaggaacttgaaaacatttttaaagttctatgtaaggaattccacaaaaacaccttttatatttttttcctgcaagaataagaaaatccaacgcaaaattgcttaagcaataagcaaaatgtattatttcacatattaggaagtctaaagtttgaaaggtttgacagttagataattcagtggcatattgacatcatcagtgacctaagtgttttctatctttatgacctgtcatcctcagtgaattgctttgccttttatggacccaagatgactgtaaaatgtagagaggcataaatgcagtctttccttctatgggtctccttaatggactttatccagatggttcccagcagatgtctcttttcagcctatttaccagaactgtgtgacaagaccaagccaacactatcaaggagaatgttcttgatctgattcttttaacccatctttatttacttcttggagctaaaaataatccagagtgcagggacacgagatacctgaacaaacctgagcttctattaataaagaaggtggaaaatagtggtttacaggaaaacagcagtatctgctacattctacattcattctaggttataaaacagttcctcacgacagagctagacaggtgtagaaccatacacgatcaagatgcagcaaatcaaagagctgtgtgtctaagcatctgaaatccatctttgacaatgactatatacatgatatgaaaaaaattttaaaaggttaagtgatagactgatttgagttgaatctaagccgctcttcatattagttgttctattccttcttatgctcctcactaaacctcagtttcttaatcaatagtcggataaaaatagaaaaataatgagaggaaagttctctgtggtaacacttatatgattctgtagtagtctgactgtttgtgcctttaccttatgacactataaacttaatagacttccaactcccagtcccacatataaggagcttagaagccaccactccatcgtaacaataggtaaaaagctgaacaaactgaaaagtcaacaattctttttagatccataaaagaggtgaagatccaggcaaactagtggctccaagattagagagacacacagacaaatacagaaaggggagtcatggcttatctaaacagagacttacaagtggaaaccactgcaggaactagtgccagggtagaaaaacctaaactgtaattgatgaattgctggagaatcagcgtggacaagtcagagtttacagctccagaaggacctaagcataagggagactccatacttttgtgtcttttatctctaagaacttgacccagtaaatattggataaaaatttctttgtgctttcagcaaagtgaggggaaaatgaatcattttgaagcatgctagaatactctcttcttaaaaaggcctccctgaagaaaaactaattaactagaccctaatttcataggagtattatcatagtctaactaacctggaggaaaggagatacccgacttcagccaggtctattattccacaaggcagaaggaaaataccaatgtccagcccactgtagccatcttgtcccacctaaaagcaaagaaaaagctgagatatacttatgaagtacagtctagaggcataggatccctgaaagacttggaactaatcatgagactatgaacatttctcctcccacaccttaccaccacattataaatacttatttacaaaaagctagttccttgaaaagatcagtaaaattgataagcctctaaccaggctaagaaaaaaagagagaggacacaagttactaagtaaaagaaataaaaaaggatatatcactatagatcccatggacattaagaagagaacgaaagggcgggcgtggcagctcacacctgtaatcccagcactttaggagcctgaagtggggggatcatgaggtcaaaagatcaagaccatcctggccaacgaggtgaaaccccatctctactaaaaatacaaaaattagctgggcgtggtggcatgtgcctgtagtcccagctacttgggaggctgaggcaggagaatcgcttgaacccaggaggtggaggttgcagtgagctgagatcacaccactgcactccagcctggtgacagagtgagactccaactcaaaaattaaaaaaaaagggagagaataaaataatactatgaacagctctatgtccaccaatttgataacctagaggaactaaactaattccttgaaagacacaatctgtgaaaactcatgcaagaagaagtaaataatctggatagggctatactttttcaataaattgaatcaataacacataaccagtcaaaacagaaggcatcaggcccaaatttattcactggcaaattctaccaaacatttaaggaacaaattgtattaattctctataatctctttcagaggatagcagagtaaatgcttcctaacccattctattaagccactattaccctaagactaaaatcaaacaaaaacattataagaaaagaaaaccacaaataaagatctctcatggacatagatgtaaaaatcctcaacaatatattagcaaatttaatccaacaatgtatgagaagaattatacaccattaccaaatggaatttattccaagtgtacaaggttggttcaacacttgaaaatcaattaatataatccaacacatcaacaggatataaaaaaaaagatcatattaatagatgcagaaaagtcatttgacaaaattcaacatacatttgtaataaaaaaaaactcagtaaactaagaaggaaatgttctcaacttgataaagaatagctacaaaaaatttacaactaatatcatacataatggtcagcaacatttccaaaaagatcaaaaaaacacaaagatgtctcctttcagcactccttttcagcattatattagaagtcctatctaatgtaataagacaagaaaaataaatataaaatgtgtacagattgggaagaaataaataaaactatctttctttgcagatgacaggaacatctatgtagggtatccaaaagaatcaattaaaaaaactcctgtaactaataagggattaaagcaagtttgcaggatacatggttaatagacaaaagtcacttgtcttcctgtatgccagcagtgaacaagtggaatttgaaatgtaaaacacaatacatctacactagcacccccaaaataaagcttgcaggtataaaggtaacaaaatatgtacaagatctatccaaatgtagagaaaataaatcaaagaactaaataaatggagagaattccatgttcatgggttgtacaacacaatgttgtcaagatgtcagttatccccagcttgatccatagattcaatgcaattccattaaaaatcctagcaagttatgttggggatatcaagaaatgaattctaaagtttatatgaagaggcaaaagatccagatagccaatatagtattgaaggagaagaacaaagttggaggactaacactacttgacttcaacatttactttaaagctacagtaatcaaaacagtgtgatactggtaaaagaatagacaaatagataaatgaaacaaaatagaaagctcaggaataagcccacaaaaatattgtcagctgatcctgagaaaggagaaaaaggcaatacaatacagaaagagtcttttcaacaaagagtgctgaaaaaactggacatccacatgcaaaaccatgaatctagatagagattttgcattcttcataaaaactagctcaaaatgaatgacagaactgaatgtaaaattcaaaactacaaaactccttgaagataacatagggtaaaaaatagatggctgtgggtttggctatgatcttttagatacaacaccaaagctatggtccataaaagaaataattgataagctggacttcattaaaattaaaagcctctgctctctaaacagaaagtgtcaggagaatttgaagacaagccacagaggaagagaaagtgtttgtagaacaaacatctgacaaaggattttattcaaattattcaaagaattcttaaatcacaataaggaaacagcctgatttaaaaattggcaaaagaccttaacaggtgcctcaccaaagaaaatatacagatggtaagtaagcctaccaaaacaggtttcacatcatatgtcacaaggaaaatgcaaataaaacaataattagatattactgtatacctattaaaatagccaaaatccagaacactgacaccacaaaacgctgggaaggatatggaacaacaggaacttttatccattgatgaaaggaatgtaaaatggcacagccactttggaagacatttcagcagtttcttataaaactatacatactcttaccatgcaatccaacaatcactttctgtggtatttatctaaaggagttgaaaacttatgtccacacaaaaacctgcacacaagtgtttgtagcagctttacttgtaattgccaaaacttggaagtaaccaagatgcttttcagtagatggatggattaataattcagccaatggaatattcagtgctaaaaagaaatgagctgccaaatcatggaaagacatgaagaaagcttaaatgcatattactaaatgagagaagccaaactgaaaaggctgcatatccaatgatatgacattctgaaaaaggcaaacctatggagacaataaaaaataaaatcagtggttgcctggggaggggggcaggaatggagcatagaagatagttaaactactccctataattctatagtggtggatacatgtcattatacatttgtccaaacctatacacaaggagtgaaccctaaattaaactatggactttgggtgataatgatgtgtcaatgtacgtttatcaattgtcacaaatttgatactctggtgagggttattgataatatgggaggctatacatacacaggggcaggggaaatacaggaaatctctgtacttacctctcaattttgctgtgaacctaaactactctaaaaaatacaaaaaaaaacctctttctaaaaaaaaactctttaagttgaggaatgtatcttcttcattgtgtccccggtagctagtacagtggcagaattgatggcttttaagtatagctaatgactgaaggagcatgttataaaatatttattaaagcctgttctataatatttggcaggtaatagacatttaataattattagatcatagctgatgatttgactcttgacagaactaattgctacttacatttaaataatgctaattagaatgacaggctattggaaagcatgcagaagaaacatatggaagttaataaacctagagtcaaggcctgcccttctcacagttattcaaccctaataaatagctttctcttgctgactctcagtttcctcacttataaaacgagcacattacctacctcataacgctgttgtgatgttgtgatgactaaacatttcttacagttactaagtggctctatgatcacttcaataaaactatgtgccaagtttctatgtaatgatagcctgagaatccccaaaagtattggttgctttccgaccagtcaataatagcttactaatttatctgggatctcatgtgacttgcttcgtctgttccaataaatttagcataaattcaatttgttcaaaacccactactactactactatctaacatttctagtatggctactttgtactaggttcttttctaagtattccatgcattcattcatggaaacacttttattattacattttgcagttgctaaaactgcattttacgtaagacaaaattattttcctgtgtttatacagtttgtgagaagcaaaagcaagttgtatacccaagtttgcctgattccagagtcaggttagttatccaccatattataacaacactcaggcaaagtttacatgtctagttaatgtcaataatggtataaacaggaattaggtaataggccatttttggctctcttagtgagatagtaattaaacattttagctgaaatttctctttactataacataccacttgataaagcatacattaattctagtctggttttgctgttgagaaattatctacatttactaccttattataacatattattcttttcattttaaaaatggccattaggtttatcttacttataatacaaagtgtactttatttattttttaacttttattttaaatttaggggtatatgtgcaggatgtgcaggtttgttacataggtaaacttgtgtcatgggtatttgttgtacagattatttcatcacccaggtattaagacttgtattcattagttattttttctgagtgtattttaatagaaaactaaacactaatgaaatcactgaagatatcataggaatataaaaccctcaagagatgatttagagttttccattttcagttcatggaaggcaaggtttccactcaacagagaaagtacaaaatggcagtcatcaggactaaaacattacaactgtagaagttacacaatgtaaagcttctgatattataggcacaaattacatcatgaaaccatttcactagagcacattagtaaactcagtttccaacggatttcccttggggccctcgccgtattgaaacaatcactatcttaagaagaaaaatgtgttcatttgttcccatgaaccagcacctagcatacctgtcttccacatcataggtatccaataaatgtttcctgaataagcaaatgaagaatgaatgaatgaatgaatgaggaaatagggaattcaaatttcttccagtcttgaaaggattgatagtctatgtggacagagcatagatgtaaatagatttttaagaaaacaaggtgcagacatgaatatttaaagaactttctaaggactacaacaattgatagaaactatctcagagatctgtggggcaggatgtaactccgaaggcttgctatccacttataacctcttccactggctaagggagacagtagggacacactgcatagaaacaggaagaaagcaataattaatgttttttaaagaaaaccattaatagttaattaagaattaagggcccatggtctctgaggttggagtcatttcaaagtactagaaaaaatgagcatagggaagaaatcatattcataagtaccttgctctaatatttccaaatgtacatcaagagaaactgttgcaacttgctgactttaaaattctagccttctctggcttcatgaaaaacttgctagcctcctgcaaagttacagttcaatctgcttcacattgggtaaaacaatacccaaggtacagaggtgctgaaaggcttagttattgttagttatgggagttgacaatcttgaataaaaagcactcttagtgcaaagtagaattgtaatcagtgtcattgtcatttgaaccacattgtttgcagtgtaaccaattgtgaaaccaacataaattcaaaaactaaattagaaaaacagatgcttcttttgtttggagattttagtcccatctagccatattgtatatcattttctttgacttacaccacatagaaagaaaaatcagagagcataatacaaaaatgcagaaacatatttagcaaatttgtggatttcataagtcatttataaactttggatttacaaacaatttcaaaggcttttgaaaatatttttttttttttttttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcctggctaattttttgtatttttagtagagacggggtttcaccgtttttttagccgggatggtctcgatctcctgacctcgtgatccgcccgcctcggcctcccaaagtgctgggattacaggcgtgagccaccgcgcccggcctgaaaatatttatacacacaagaatctctataatactacatataattataccatggcttttccaaagcatattccagagatagactttcggcagaatatcaagtttcctatttggggtttgtcttggagacagtgaacaatttatttttcagtctctgtctccactgatgcttgtgattaagataaatacattggtgcaatgagagaaaagagatttatcttgtacataatttctaaattgacttgtgacattaggaagtcgatctacccagagtggaatttgtttcttcagttcactgaagttcagttcttcagttcactaagttccaactaatttttgtttctccacagtctcaactattttttaaggaaattgcgaagttcacttttaatgtttctgaactaccagacttcctatgatttaaaaaataacaactgtaaatttgcatgaaatctttggcattatatactcaagtatagcttcaattctgggccaatatacaatgctgatttgtgtaggacaaatatctagaaaaataggtatttttgaaaagaagataaatactctaccaatgcaagttcaagatgaaataagagctacatgcacacacacacacaaacacacacacacacacacacacacacatccatctgcatcacatatctcataagcactaagggaaaaaaaacacacttttgtgtttatgatgttaattttaagcaatcaaaagtataagcaataacatatgttttgccaagtttacagtacaccattgtggttataagcatagggatttaagctttgttttcaatagtctgaggtgcttgcattttgtttatatcaacattttacttccaacaatttttttaaaagtcatcttatttgtagtctaaatagttcttggtaaaacacaaaatctcttagtgagtagcaaatcggggccactaaaaataaatttcctctttgttgcaaatgagacaaaaactgttgtatttagactgtgggggcagttaacaaggtctaggaaacctcaacctgctaccccaaaccttttgtctgactacgtggataagaacagatgacaggagagtgggtggcttcctggagagaacttgggctttaactcttattaactgtatttcctagtagagtagcatctgtgcatactagatgtgtaagcttcaacaaatgatcttgccctgagtctgttttattgtctgtaatatgggtaaaatattatatttttatgagattaatttaaggatttgatggcacaatgcatgcagaatcattagcatagaacatatacttgatatttctcaattcttcttgatttccccttcctgtctttctttcctcattttcaaacaaatcaaaataaaactgaaaaagtataaagtatatcacgggaaaatttagaataaaatatattttatttttttctcaacattagaaagtcaactaaaaaatgagcagctatcataccaatacatcgtttagtatagggtagtcagttgacccacacagtaatattaagtcaattcagctgtctttgaataaaaggaaagagtaagcaagcaaaagaaagagagaaagaacaatttaataattacagaggattcttcccaccattctaataatgaatggagtatgaatcacctagcaagcaagagatggcagacatgatttggctttccattcaatcatcacccatcattgaaagatgcttattttcattacaatatgacacctaaattcatgccaactatttcatctgaaactcaaccaagaaaatggcaatctgttctaatgctgaaggaaaatactggttttctagtcttcaacatgacctttcagagagattttcaatggaccttttaaatatacatatatatgattttcttcacacttcataactttagagcttaaattcacatttgtcactctactgtactaatatttaagtacacaacagaatttaacattgtattatcattaaggagcatattagaaagttaaaatattctataaaatatactatataagcaatacatatgttcagataatttgtacttttggttattaaaaagaatttttaacaataggtcatcaaatttttgtagttgaagaaatattttcagattttgcgatttagaattgaaatttcaaaagaacatagacagtaaaagtaaatattagtgaaatattgaactaattagagggaagccaactgagatatttctaaaacaaacaaaaaaactaagtgtatttactacatttgtagggtaatggggaagccaaataattttcatgggtttcagaatgaatgatcaaggtggaaagcatagaaaaatacttgggaacacctgataagcaaagagtaccagccccatacacacacttacatgcaccatacacacccacctgttactcaagttttcagaagtgaagccaccaaaagattaaaataaatattggtgacaaaagataggtgctgctggagtagatcaaggttaatggaggtccttgaactctttgggatatcaagaccaaaaataaaagcttcctttgaagtttgttatctggagaatcagacagacttcttactcttccctggttctagggaccatgtgacaatttatggcaaatgacattagatattaatctttgatatttagtagcatagatcataagcctttttcaaatcaggtagctagaatcatattttcaaagtacaagcccttaatttccgtaatagctacaaaaggtggaggaggacattttattgagattattgttagccagccacccacacacatgggatccaaagtatagtgttctttgcttcatattcaaatctaaaatccagcacatactgagcccatagtgaaatgtgtttacatacacccaacagacgaaagggaggcaacaaaggagactgagaagaaatggctaggattttcagaaacaaaattaggaggctgaggtaatcacttgtctcttcagggatctgctacttcttgaagaggatttatgggatgttacaggtttctgaggcttaccctctgttgtctataactgcttattcatgcaggacaagagaagaaggttaataagtaccctcagggatgtaatactgaaggactttggccctaggtaaataaaaactccaccattttgttcattttaaggctggaattctggtagataagtcaggtaatgtgcagtgaagagctatctatatccagatatcatagaacagattgaggtgtcctagaccatggctcaagatattgcaatgatggcataagatagttggtcaaagaatgaacaatacaagagctgaataaacataaaataaaatgtaggagaagaaaaggaagccatctttaataccagttattataaagaacaaagaatgtgagtgagaaagatagctccttgtaattcagaaaaagaaagaagcaaatgagaaaagaggacataatcagaacttgaggtcaatcagcataataattttagggtatgggtaatcaacagagtaaacttacagtcttattagataaagggaactacatactatgaataataaagcacttatgccatgtgcctcaagcttagaatccagaattggaagtgcataacttaatggaaaaagtccacagaaagtatacaaagctagatagatctatatgtccatgaaatataaatttgtgaggaaatccatgaatcagaaaatggctgcaagctggcagagtcttattggaagcaaagaaaagaaggcatacaagtaatatttatttatgtgggacacttaaagcttttcagccagagaaaatggaaaatgcattactgtcatatatcacaaagcacatataaaagcaaaatatggtaaagatggtgagctttggttatccagatttattagttttttattgctctgtaatgagttaccacaaacttagtggctttaaaaaaacacccatttatttgctcaggattctgtaggtcagaaatctggcacagtgttggcatgttctctggtcaggatgtcacaatgccaaaatcaaggtgttaaactcaattgccatttggaccctgggatagaatccacttccaagatcattcaggtttttggccaaatttagctccttgtggtcttaggactagggtctctgttttccttgttgactatcagccagtggctgctctcagctcttagaagccatctacatcccatgccacctgccacctggttgccttcatcttcaaactagcaactgtgttttgcatccatctcctgctttgaatctctgacttactagtctgtgagcagacagagaaaaatttagttttaaagagcttgtgtaattacattaggcccaccctatcttaaggtcaactgtgccaaaacttaataatgggagtaaaatccatcatattcagagtcccaggaactaggcagggaatgaacacgagggggtgggaaatctcgagggccatcttagagttctgcctaccacagtggacatctgtcgtgggtcttcctcagcaaaagcagaacaaatgatcactggtgacgtgataaactactgacttctccataaggcatgtgagcctccctctgctctgctctgctgtagtcccttgggatactatatcactctctcgtgctgcccttaagagaagcagtaccaaattggaacatgtttagagataaaaaatgttcttgcaactgtgtatagaaggaaagcctgaagggtctgagggtgtttagtgtgtaggataggggtcatagagacaaaattaattattttattgatttaaaatatttgcagtgttgccacaaagtaaatattcactgtgggtctttaaggtgtacagtaacaatgaataggtgaaggcaacaagaaagaattctagtgagagacatagaaggaattactaggaaaaaaattatggaaaatccctggatatacctagctactttatcagatactttattctttagaatataggtaactagaaattaaagaataaaatgaatttatgatcaaattggtaaaagaaactctaggttaagcaagtaagcagccttttcctcccactgcaggatttctcaaagactttattatggtccgtaattctcagaaggaaagatatggcatgcaaaatgtttcaggttaatagaacatcaaacatattttttatttagacacctttaggactggtattttacaaactttgcttggtaaactgctgtgtgttatggggaatttgtgtatcagagagtggttcaacataaccactgcaatctctttttctatttcaggacacatttgggtacttagctagagctgagtcatctttattaatgtgagctgaatatctacacagcagccacagaaaatgagtggtacctatttgaatgcctatgggacttaactggattatatatattctcacagaaattagttagaaaacggtgctcaaaactttgcctcctcaaagtataagtaactggatgaaagatcacctgagcaaaatcaattgtgaaaaacttgttccagattcaacaaaaattattaacaatagtatattagttcattctcacactgctgataatgacatacatgagactgggtaatttataaagaaaaagaggtttagcggactcacatttccacttggctggggaggcctcacactcagggcagaaggcaagaggcacatctcacatggcctcagggaagtgagagaatgagagccaagcaaaaggggaaaccccttataaaatcctcacatgtcgtgggacttattcactaccacgagaacagtatgggacaaaccacccccatgattcaatcatctcccaccggggtccctcccacaacacaagggaattatgggagctacaatgcaagatgagatttgggtggggacacagcaaaaccatatcaaataatgatggaaattaagaaattattgtgatctgctattctcagtaaataattcagaaaaaatctcaatcttcatgatttgtaaatagttgaaagctagtgcacttaatcagcttgggagctgcatcttggctgttctcataaatctcttgttgaggaagttcattgctataaaaatgttagaggttttccctattgcttctttgaatactaatcattccaccttccttttatataacactttgacgaaacgaagctaggactatcctgatatggtgaaatatttctcatagtagattctctgagcttcattatagagaatgttgcagtccaataaattcagcaggttttgtcattttaaaatttttattaaaaaatctttaagataaaatataactaactcttcttagcctcagtataccaaaaagcagatattagtaggaaaaaaaaaatataagggaataccttccgaaagaatctcacaattcctgagctgaaaaaaagtcttctatattcttaattccagctaagcaggtaaaaaaatctagtactaaagagatagcaaggtgtgactggagcccaggccatctaactcagtccaggtctcttacattaggttttagtttttgtaactttgttctattatctatactcctcattatcttttatgtatgtgcgtgtgagaaatattgtaccataaatatgataaatttattttgtaattatctgtcattatataatcaaatgtcaaatagtcaaatgtccaaggtagacatatttagttataatatcatttctagtagcaaaccttgaaatctctaatcatatgttctccatatctatttctcttcactgatgactgattttttttttactaccgtcaacatcaaaatatatggaaaatccattatttcaaaagagcaatttcagaccaattttcaacagaaaagtactcaaataataggctctaatgttcttacatgaatactgtataaatgtgtccatccctgcagaagttcttatcatatcctgcaaaatagcaaagctatcagttactttcggtaaagaaacaatttccattttactctaggcctgtcttttgggttacatcaatgtctgtaattcacatttctaattttaagttaataaaatttgatattcttcctgttaatcattgtaagcatgggggaggatctgaaaaaacgtgagatggggaagacatgttttaataagaaattcctaaatggaacttgattttttaaaaaagaacttgacacaaataaaatattcttaaaaatagaacatctcaatctgtccaaagacaggtaatatccatgtaaaaattctcatattaacccaccaatgtccttcagcctgtgttgagaagcaccaactctcaggttgggggaatagtttatcctcccaggtccactcaattcttggcctataggctgagattgccacctggggagccaattagtgccaaatatgttggtggttttctgatgtaggaaaatctcccctaagaactggactgagatgagccatcaaatgatagtgactttcagtcactaatgatctggaatttagatagagacttttaattgggttaccaagcaacctgcaaatattttggtgatacctgctgagtcaattgggtagtttgtaacccactcttctctgattatgtaatctttgatatgagtacattacatgttataaatgatcagcatggtttttttttctttgtcattagccaagaaaagacatcactgagtcttttgttcattccttgcattatgtttccatgtgtccaaaagagggtacacagagtaaagagtggttatagggaatagagaataagtattcattaagccatcttcttatgccccagtcttctgctaagtagagttagacctcgtgacatcagaaaaggctacaagcaattgttttgtaaatcttatttccacttaattaacagagctggaatttcatgtctgtttcttagatcattttttaaaacataagaaagtgaaatgtgagtgtattgttatatggttttattttaccagagttttattttcaaataaaactttcaagaaaaataaattctgcctctcgttgtttccagatgcctctgtcagttgctgtggtccagcatattcactttttcctgactgctcctgtcatttccttctgtctttcttgctcagctgcctcacatgggtctcaatcagttccttaaactacaaccttgagttgtcttgcccccgtttggggtgggtattatttttcccagtgctactgttctgcccctctggcttttaggtaacatttcacattggctttcaaccttacacgtcgccagatacacagtgggctcttcagaaatgctgccttttccctttgacatgtgtgtgtggtgtaactttcccactgtagacgaagcagtggccagacctttccttctcccagcttttcttctatagccagcttttcctttctcactcatttgaactctttgctggtaggtattcctatgggaaggtgtgcactgatggtctggctttgtgtttctttgagagctttctcctctccctttgagaacttgtaccacgtgagaaataacatcagtagacctaacttttccattcctagttgtattgcaaatgcaagcagtcgagcaaatgataacaaatcatagtgctgtttcaaaggttgcattcacaggacacttagagctctcgactgcatttcaccaatgaggaaaccgagggcccaacatgttaaaaggctagcaaatgttacataattaatagaaagtgactgggaattaaatcttgtctataactcctaatcacatgttttgtacggtacctcatggtgtctcatttgatcactgtattcctgatccagtttcacttgtcactatgtgttctaaacagaagttaaagtggcagcagattcgacatgttttatatagagagatttcattcataaaatacaaaatgaatgacaatattatcaagaagggaaattgaaataaagagaaaaagtcatgtgaaacatatttagttgtgagttgaagctctaaatgcttatacaagaggaaagaatgtcccatgtcattttatgtatcatatacctgtgaaccactgtcaccctgcacaccaaagtgtcaaaaattaagtgggaaaaaatcatacacctaacaagatgttctttcaaaggattatcctattaggtttggggttggagaaacacctttctgttgtatctcaacttagcactggggcttgggaaggggtctagggaaagcccacctcttccttacaaactttcccaaatgtgagttttatgttgagtcccttataagattatttccaagttccttttgagctgaatgatcagctgggttcccattaagagccttggcaaagagaattcttaaatgtgagcttgccaaagtatgaaatgtgatttctgatagttgtttttcctttttcatttttttcctcctccttactcttctctgaccagcctgaaaagtgatacaaaccaggctgggaactacatgcttgcaacagagtaataccctaattatcatcctcttagtaagggctgcttttgacaggtgtcaattagatttaaatggttggctgtgctgttgggttcctttactttccctttttttctacactgtcattccttgaggtagggttaaatgctgacatccctttgtgcttaaccagagataactatcaaagcaatgtataaattacagctccagttacactgatgcttaggaggctcatccacctctaatgacaagatatccaatcaacctgggctatagttttgtgaacagagttgtgaagtttggttaatgaaatctcacatttcacatggttcctgactgtatttttagatactcttacaagtaggatatcctagttagttattctatctttttatctcttgcatgaataaattacagagttctgcttcttatcaaagaaagcattcactcatcatctgggaaacacaaaacactttttagaccataaattattcctaaagaaaatcttagatgagttgggtactccttgttgtgtatgtatatgtgtttgtgagagagaaagaatgtctgcttgatggcattcattctaaatgatcatagacagactacccgattgtcatcttacctgtcagtccttaaagcaaactaccctagaatgcaaacaagcaagccaccaccaaaaatatcctttccaactccttgaccaaccactgtgaatgaccgaatacacccagttcctcctatggcattttcttccggcttactggcagagaatgtgatttcgtggtagactggtagacggttggaaaatgaccccttataatgatggaatttacataaataaatgctgatagcacaaaacagataatatgctgtgggtatcatcacaataagttgtctcccactgacacagagtctaagttggaagcacacaattatgcaaatcaaactaatgccagttgctcattactgtcatggtggtaaaggcaaaaacatatcctccatagacagctcgagacggggccacaagccaaaatgtttggttttgctgacacagtaactgagtcaacaaaaataggatataatagtaatacatcaggggaacccacatcagggtagacctgaagcttaatggactgtgaatcctatgtctgtgcagagcaccctttcactggtattgacccataatacgtctgcttccacatttgccgattatgtagaaatagattacagaagcaaatttttttaagacctgaaatgtctgcaagatattctattagcttttcctaaaacagatgatatgacatttgtaaatacttaaataatgtcacatatcccaggctaaaacacttcccagaatatttcaaagtacctgctgctgtttgatctaggtttgtcctgagttctcattatggcactgaagatgttttcaaacaatagaatgctcatttgccacataaacatctttcctatctttaaaaaaaaatagaagagctgtcaccaggagaatatttaaccctgaatatttcacagaaccttgaaaaaaaatttggccctattgtaggttagtgaagcaacaggtgctgacccaccaatttaatccatttctcttctgaatgacagggtaacatgtggtggattgatgttataaatggccctgatgcttcacccttcatgatattcatgccctttgccacaagattttgctgctcttctcatcaagaagtatctttccttgccccttggctttgagtctagtcatgtgacttgtcttggccaatgggatggaagcaattttgccagaagcaaacgcatagaaaagcatctgcacactgccaagtcagcttatgctataaggacactgtctaggaagaacatgcttggccttgcttgctggagggcaggagacacatggaagagagctaagttgtcctactaaggccggcctaggccagccaacaatgagccagcccctggacagctgagtgagctcaagtcagaaccaactaaatgagtccagcctacatcatccacagattcaggaactaataaatgctgaatgctttaagcccttgagttgtatactgtttgttaagcagcattattgtgttaacagacaactggagagttttcacaaagttttacaatatcaaaaaaatacaagaaaaatataccctataaataatgcaagaaaagattatttagtcaccagatttaaaatacaaacacgggaaaaatggaaattaaatcacaatgagacaccacttcacacctgccagggagaactataatcaaagatagacaataacaaatgtttgcaaggatatgaagaaattggagcctttgtatgttgctgttgggaatataaaatggtgcagccactttggaaaactgtcaaacagttcctcaaaatgttaaacatagcaatactcctccttggtatttacccaagagaaaggaaaacctaggtccatgcaaaaacttgcacaaatgttcatgagagcattacacaaatggccaaaaaggaaacaattcaaatacggatccacagatgaatgaataaacaaaatttggtatatccatacaataaaatattactcagcaagaaaaaggaatgaagtactgatatatgtgatgatatatgagtcttgaaaacattatgctgaataaaagtagccagtcaccaaagcccatgtattgcctgactctatttatacaaaatgccccaaacaggcaattctatacataaagaagacagattgatcattgcagatgtggagggcatgggaattaactgccaaagagtacaaggggtttcttttcaggtaataaaaatgtaaacgtagatcacagtgatcacggtgatggttacacagctctgtgttatgctaaaactcatttaattgtcaataggtgatttttatactatgggaattatatctcagtgaagctggtaaaaattacataaacacttcagcctcatcttctgaccaaaacatggcttgtttcttgttttaggctctcttatatctaccttcttgattggaagctttaaagtgaaaacagaacaaatcaaaagtcttagtattgcttctttagaatcacacacgtatttgctgtatttgacacatttgaaaagtgaaataatgaagaatttttgatgttctataatagacactgatttttcacagaactccagctctgtctttcattttcatgttttctgtgatactcatgctcggcttgctcttaaaactcacctgtgaaaaagaaagggcactacttgccacatcttaggtttgcatatcaaggccaacttcagtgtgtaaacgacacttgcaccaggcatgcttggagctgttcccaatttcgtgttcacagcctctcctccagcagcaggtttgaggtttaacttgcccagttgtgagaactgagtaaatagacagcccgcagtgctgtcatctaagttacctcttctggaacccccactcactgctcccgccacagcttttcttcagctcttcatgatttttgcctaaattaccacattttctggactagctcacttgcttctggtttcactcccctcgagtccactctcctaattgcccccagagtgatggttgtgaagtgggtatcctggccatttcatacccttacaaaaaacaattctagtggcttccaatccatacagataaaagaaaaaatttcatagtataacttggaaggcctttcataatccgacagccgcgggaaatcttgccactccctccccttggagctaataaacatttgctgttctctctcgtgccttcaaataagtgctcccttgtctttatgtgtggtagaggagaagaaattaaaattacaaataaattaaatatattgggagagacagaaatggggagttgctgctcaacaggtataaagtttcattcattcaagatgaaaatgttctagaaatctgtacaacattgaacttagcgttaacaatactgtactgcacacttaaaaaatttaagagggtgtatctcatgttatatatttgttacaatagaatagatgaatttataaatatttatatagatttggatatagctttactgacctctcttcacttgataagccccctcatcctcttgcagtccttttagcaccaactctgccaggaggcctttctaaatctgagatttgtgtcctctcgtattttaagctactggatcagaaactacctgtcctaaacccacctgagcaaagcaccctcgtccatgttgccagcagtgctctatgtacacatgtacacatcacacagcattatcattcctgggttttatttttctgtaaactttttgcatagccaattgttgccagtccatataatgtctttcttttattactgtaattcattttaattagttaattcctgcatcctcattttttcctgccattactctctccctatagccacctgctgtatagcattctttggattcataaacatgtatggattcttgattgtggataagactgtgaaaatgtctgcgtattttacacataattgctattcacctgtctctctgctgctgaattggaagctacttgaggaagggaaaccagccttttcccaacctgaacaccttgcacagtgtctgattcccagtaagagctcaataaatgagtgtcaaatccatgcatgacatgatacattaatgaattaaaagccctacattttagtttaatttctaataatcttggtgggctttacaagttttatctctcttgctacaaatctaaccatgagaacttgcaataagcgctaaaaatcttaaaatatgagaccatttgaatctcagcctcttttgctgcccatgtcttccttctctggcatgtccctgaagcactctgtcccaactgatactagtagatattttagaccatctagtggacagtagcttaaatgtttgacagatttctacttctttctcaaaatggttgctgattaatagctgaaaggatcaaccccagagggaacctgaggtttcctacctgcccaaagccagctttcacattcccatttcccaccagaggactgcaaagatttttcccttgactttgaaataacacttggttttacagtctgcttgcctgtggtttaggaaccgagcatgtcagcactcctttttactgcctcagtgcagcagcaaatgtgttctgttctctcctttcaaaagtgaagattgtattttaaaatcactcttgcccctagggagccactcactcctaactccctgacaggccatgaggacctcaaaattaagaaagatgtccagaaatgtgagtttgtacagaaaggactagaaaaccacccagacatgtaacagctcggttacgtgcctggcttctgtcaggagaaatgtgtgtctgaattttcaggctcataatagacatgtacagctaaccgacttttattttgcctctgtcatattgatctatcagtgaatctataatagaagatgggagcttggaaaagtaaaaagtaataaccattgagatggatagcctgagcagaaatgtagtttcatggggacacttagtgcaaagaactgtagattcatgtcaagggggcacaagtatccccttcaaagccaactgttaaaaacacctagtgcacagatgacctgccttcagaatatgatatgtttctgtattgattttcagagtttcagaacaacaggaaatagccaaatgaaagtttctttgcagagcactaaaagtaatttaccttctgcctttgatttcagcttcagattttgttttatggtgcaaagtacaagtgcttattttaaaaaattcatttctaacttatggtggaaagcagcaccagagaccaaggaagtgtggagcaagaaatgagccatgaaatgaaacaaagcaaaaccccccaaattgcatcaatggagttagtggtaagtcattacacaatgaagtttgtcttttaagcacaggcccactgattggcaggcaggattttaccattatcagaatgaggagcctataaaatgcccaaaactgtggctttgaagtcatctatatttagcttctgtaattccatcttttgtacatccctttgcatgaaaaataaagtgtcatattcaaataaaattggccttccaggacagaagaaaacacagtttactttccagtacaagttggtaccatttgcacatgtttggtctacaataagtactaagcatggggcaatactaataatttgtgagtcttgactagacctctttttttaaagagattattcactttatattcaaataaatttggtttatacagtatatgatgatgcaaggaaacaagtttcagcttattcaatgcccaaacttgaaatttatttgtttccattgttttcttcatttggggctttaagaagttgcattaagcagagttctggcaagaaacagaactcaaaagaagcaattaaagagtttcaacagaggcacaaagcatgggcagggttaagggaattcaaccaaggagggtgaaacaagcattcctgaggctcccaaccaccaccacgtctgaagtgaagagagaagggaatgtttaaagagtccatgcagcctgagtctgaagggaaggccacccaacaggagctggggccgatggaagaggagctcagacactgccaatccatgaaccgagggaacaaacaccccgacttttctttcttcatgtcttctagcttcctaccaggggctcctattgggtgaaccccactgaaaaccagataaaaaaagcttagtttcacagtctattcatatcagcctgctgaaacatacagccaagggagaaagccccagagtgatccagaagggcacattaaaaaaaacaaacaaaaacgaaacaaaacaaaacattgtatcataagagtattttattctagatatgtgctctatactcatagaactggcaatataattgcaattcttcaacttcagcagaaaaacaaaaatgcagctttttgctgcacatatgacataccctgaccaagttaagagagagattcggctttgggaagaacaaggatgaagtaagagtatctataagtgggagaaactgttaagatcttccgaaatagaagttaaacgaaattaaacaaagcagaacaaaagcaatggatatctgttaacctttgccttccacttcttagcaaataaaacattacagcaagcataaatactgtgaaaatactcccaggagccatgggaataactaacctcttcctcactctctgctcaaaaaactctcctaatcagactattggaatatgccccctagttagtaagaaaaacaacaggaaactgggatttgctttaaagacatttaatcatagactatattttaaaatgtgcattatatccacaaaaagagtgatatcagtatcatatgtttgtcaaaacaaggttaaaatgtatatgaacttttgacttttccctgtccaaatcacacccttgtaaggagcccattttattgtaaacatttaaatctgttaggtattagatatgagctcagttatttttgttttgtgtatttttttattcacagatgtttttattatgctttctgcaatcaaatgatctgggttagaattagaggattagaatgccattggatcttactttaaaaatacaaatttatctattttcattaggaacctgacattcttatccagaaaatttacattccatactgaatccaggtattatgtaacacatattggttgtatttttttaaaaaaagtaacaactacttccctacatagataaaatatctatccattatccacctatctatgaatctaaatttacaatgaatcaagtgccaaaaatagcctagcctacttacagagttctctctacaattgccagtcactggaaaaatattcacaatcctttaagtccattaggatggttggttctcacttcagataaaatgataactatgttctgcccaaatttgctttgctttcattctttgcttgcactctcaacaaaaacaactttttaaagcttgaatatttcatgaacagttttgaatggcttcaattgttctgtatttttaaagtgcagataactgtaggaaaaatatatagctaaagatgtctctcgaagtatgttgacactccaatttcattagaacaggattaaaatgtatatttacatgttgtgtgtaaagaaaataccagctttacagtggtaagtatatatgtgaaggactcatttcagcatatgactatacatacacccacatacacatgcatagacataaacacagacacacatatgcacacatataaacatacacttacacacataaatgcacatatacatacatacatacacatacatatacatagatatatacacatacacctatatacatactcatacatagccagccataaacacatacataatacaagtacacaaacacacatatacacacatacacataggcatacacacatatatacacacatacatacacacatatcacatgcatacagataaacacatgcacacatacacaaacacatacaaatgaacacatatacatacggacatacacacatatacacatacacatacatatacacacacacatccacatccatactcatgctgacctgggataggactgtgaagaaaaaagataggatttgaaatcagaaagttggcattcaaacctgattccacctcttcttaattataatcttaaacctacactaccttttaccctatcaattacttctctagcaactcccctgaaccctgtgctctcatccataacttatatatttgtaattccctgaactctctgtataggcatctgccatcactcatttgcttcctaagtaccattgccttaagttcgctcatcacttgattttgttaacttgtctcttgtttcaagtctcagctaacttgtcaccttctctaggttcccctcttgaatttctccaaactgagtcagatgactgcctcactcttactctcctgtggccactgtacatatctcctatatcacagtgctatcccattgtcttttgaatttctgttaccttgcatgtcttctccactggatcaaaattctttggaggacagcaccttttttgtctactttcatattttcagtaccttatatggcacatagttagaatttcaatgagagttttatgaataaatgaatcttgaactcactgaatttaacttttgactcccagcctcaccaaatctttaggtactatcctttcataaagaaatgagggaacataaaattccaagtgtttcagaaacatgctaaagtaaacaacagaaagagtggagcagaagttaaacccaaggctgtcttacttcaaagactgtactgtgtcatgttccctttccaggtagttctccaaacctctgtttatcagagaaatggggctaagaaaactgcccaccctacaaggctgataaaaagaaccagagaaatcatgttagttaataatttggaacagagttacagaaaagtctaacttttttattttacttttacagaggaaatatctgtaaatagcacagagaataagtgaatccgaagagatttcctggacacgtttccttaccccaacttacaccaaaggttctctttaccaagctctatctggccaccttagtttccccctagcatgtgtgctaagcacagatgcactcctagagtttatataaaccagcactgacaaggaaagtatagaaccagaatgaagagtatgaggctcaggaaggctgctcattctatttgtctgcaaaatgccatcagtttgcagtttaaagagagaacaacataagtagagcaaagttcaattgctctccaattagccctaattaacgaattgaaagctgtttgtatataaccaaagataccttttgttttgttgttgtggttcagcaattgagatgagtagtccaagtgattagtaactaccagagaagaaggcaatttggggacaagtacatgcaattttagtactgttttatggggtaaataatgagtttagaaatgttttcactattttaataagaaaaaagaattttaacaaacatggattatttgtagctatccaaaggcaataaaatccaaggcaatctatggaaattagtcccccatttttgcaagacaaacgtgtgaatcaattgtattttccaatgctctgttgagaggaggtatctcagaaacgcaaaatgcattacttcatattagcaatgccattcctactgacaatgtaactttcagtggctctaactcgagtccaaacacacgttttccacaagagtcccatgggaacttgcaatcaccttttcatacccctaagttggtgcagatcaggagcaagcccccctggatgctaaagcaggagatccttctctctccttcttccccaactgtcgtgtctataacttacaaaatcaaaatggagtttttagaaacaggatgcttggactgaagacaggaacgtgggatggggccctgacaggagcaggaatcacatgcaactggaggggtcatcaatgagggccaggagctgtgtgcttcctttcacactgtctatccatcagtaattttcacctggtgctcagtcattttctatctattataaccaaattcccagccagctcagaatgggctggccttgaatatccctgtctttactgaattctttctttcttaactgacgctttgtggttgaacagatgcatcccagatgtgcaaaaaatagttcacattcacagagaataaagtcctggctcattaaagggaagacaacattccgtcctggcttagaataccaagatagcatttcccagagttgacagcgaattggaaaatttaacaaaagccatagaaatacttcctgggtcaccaagaaagtcataacaagagaataccattgatatgccacccagttccaagggcttcccttggcacttagcctcctagccatttcacacatactcacctttcctgactcctagttagacctcgtgttggtacccatatacctttttttctggttcagaaaggctggccccgaaaagcagtagcaaagctctagctctgcgtggtggcaggtgcctgtagtcccagctactcaggaggctgaggcaggagaatcgcttgaacctgggaggcggaggttgcagtgagccgagatcgtgccactgcactccagcctgggtgacagagcaagactccatctcaaaaataaataaataaataataaaaagataaaaaaggaggaaggtgaaatgggtgcatgcctatccttcactaggaaagcgattatagtggtctgggaaaacagaatgatgctgaagttacttgagaaaggaagtaccaccatttgctgtggccgtaatcaagtctgtaaaggctgcaaagggtctgagcatgttcctccaattatcaaaaacccattcacaactcaggaactctcaagaggttcctcccttctctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagttgactaaagaagatagaatgaaaaggaaccattgcacaaagatatgtttttatttgaccaacaggctttattttgattccccaatcttctggaactcagactttctcagcaaacaattgcactgcccactgagagtaaacagcaaacctgccaatatcacaatataccctgagatgaacacgtgtgagggaaagacttcatatgccagacataatcctgatggttcccaaatacacactggttcccagataaagtctggtgactggctaatgcttttcactgtgattaaaagcaaatactttaaaaaatatttaatgattcattattatatttttctgagtgcttaagtctattgtctcattattgtttgtttattcgtagtttgggaaaattttgttgggacaaggtaacaagatagatctcagctacagccagaagtcataatgttcagacacacattaattctgtggacaatatgagaaaatgggagcaacaattaccctataattagggttgtgaactggggaagggcaatgtccaatatcacagagggagggttgaaagaaactagagatttgacagaaagtgatcaagctcacaaacgtatctatcattgcctcattttttaatgttttaggtgaatgaatttgagtttctgtgttgagcaatgacttgaatatttcatctcactcatgtagcccttgtcacaaattatttttcctactttagaatctactggactgctataaaataaaactctaatgcttggaacaacaataacagaaaccaaaattttatgctttgttcttttacaggccccttcaaaccccaggaacaggtgctttaaattaggctgccgaaggccagtggggcctggctttattatactttggtaaataatagtcactgttgtcatcagagttctctacacttccagaaaatgtcactagccacatgtcagcagggttctttgtctaatttctacagctaaggtggcaagaaggttattagaagtaatagcaaatttaaagttttattagcagtaaactgcaaaagctaatggtgatgccaacactagataaaatcattgtcacagttaattctgaactccttatttcaagcttaataataggaaactcaatggaaaggatattacacgccccatatcactcatgagtgcctcaggcctgagtaacttgttattttgctcatgagtgaaataaaatgcagattatactgcctgctatcaggggcattgttttaattgagggtgaatgcatggtgatgaggggggctccgagtaggttctcatttttgtaaatgttatgagaatattcttctcatttgtaactgtgactcagcacatcacctttctattacttgtgggggtgtgtgtgtgcttttagagttacctttgtttcagctccagagaaatgaaagcagctggggagatgggagggtagcatttggtgcttctcaccagcatttctgcaaaagtgcctctccagcattctagcgcctttgtcttcaatccctcagtctacagaggcaaacaatggaatatctgtgttgctctgtttgtctcattccaatcctgtatgccagcacacacacacacacacacacacacacacacacacacacacacacacaaagcccttccactctgatatacactcccggccaggaataaataatacaagatgcactcctctgtgctttacatttactaagaaaataggtgtttccgagaatcaagatcacgtgggattttgtgttctttttctaaagtatgttgctctttttttcaaacaagttgaagtgatttctgatcctatgccacaaatcatccaaatgggctgccttgagagccacgcatgcattcctgctttaaggggagccttccattcacttgacacggactgtctgtaattatgcagggctaacttcaggctgcagtgtgcgtggagacgactattttgaagcaggtcctattccctttgattgaagttgaaatcctaagacttccacagccgagatcatttgtgcctctctgagtttcaatattccctttgaaatatttgtctgatgatacaccgtatggacagagcctcctacagttcagtttctgagcaattatcactccatggcaatttgacttcatgtagcagtggagaaataaaatacttaaggctgctgccagcctgcctaacaaagcttttgcataagttaaagactcagaaaggggtgggaaacagtagttaaacctttgctttatcttttaagtttgtaaaacatataaaatctgagttcaaaatcttagaggttgtgacagacttctccattagcaggtgaaattagcccccaaattataatcttgattgattcaataatgttcaactagtagtggaatgagttttattttgaataatttcctcactcctgtttctctgcatcctatttcagtttgcagtctgtcctttaaatggcatttcctttttgccaaagcaccaagctgtgaatttattgagaaatgggtgtgtttacaataagactatgccattaccaataagtcccattcatatcagaaaaaattaaacattatattcctaaattgtaaacaaacagtcctaaattccagagattattattcccagaaaggcaaagtacagagccaagagaatttgtaaatatgtacaactttacaagattgatatggacaccgatgcatgttgcgctcatctccacttatttcttattcatacacatcattcttatgtttgacaatgaatatggtattgtggcacttgaaatcctttttttattaaaaaacagaaagaatgtcagccagttaaacatgatattaggatttcatcttatttttttgttttgttttgcagcaagagaatttaaaagaaccatcaatcctctctaaaaggtacttttaataaattggcatacctaattttgcatggatgccatgatgtctggcctgcttctatttggagtctcttgggatctatacagatttttaatagtcatgagaacttgtcttgtactgtggattgtagaattgtcttctattatagtcagctatccactctatttaagacagaagtttcttttgctgctttcttggagttgtttgatggtttatgaatacataaaaatctgttggtaattataggttaacgtaattagcaaacattttaaacttaatgttttcctaggaacagtttttgtcactttttcatgattgtttaaatattatatctttaaactctgtaataatttcatctaagcaaaagccttgatctttaaatcatttgatgaaccttaactatccatgatttgtttcaaaactaagtccacacggagacttcactatgccatgtgcctcatctagttattaaatgtgtgatacgcgtgcttcttaatgtgtgcatattagctatttttaaattataattttaccatgaagaaatgaataaaacttccaaaaatgtctgtctcagtggaatgtacactatcgtagggagatacgtatatatatagtatattggttggtgataagtgtcatggagaaaaatcaggcagaaaagataatgtttagggagagcctctctgaaaagatgacatttgcacaaaaggccccaaaggaagtaaggaagcaagccatgcagctagggatgccatgcagctagccatgttctaggcagagggaaaagcaattgtcaaagcattgagacaggggcctccctggaacatgtgaagagtatcagggaagccaatgtggcagaggcagtgggagtaagaaaaagagaactgcagtggatgagatcagagaaatggtgatggtagagaatgtgtgtgtgttgggggggcatccattgagtggcttctactctgagtcagatgaacagctttcaaaggatccttagcagataagtgatgtgatctgccttatgacttagaaaagaaaacctgagctaccctgagaatagaccctcgagagaaaaagggaaggaaatagacgagttaagaagctgttgaaataatgcagatgagagatgaggaaggtttgtattatcagtagagatgggatggagaagttacattctggatatatttagaagctggggtagataggatttgccaacaaattggattaaaaatgtgaaagaatgaaagtcaaggataattccaagtttttaatctgagcaaatggaaggtcagaattgccatttattaaatggagaaaagtttgggagaagcagatttggtggaggcaagtggataaaggtttgaacatttaaggatggggttgagtaagcaattgcatctagaagtctctatgtcagggagacagcttttgcttcaagattttgaggccatgagaagaagagaagaagtccaaaggctgagttcttagacactcattgtttagagttcagggagataaggagaacccagcaagcaagactaagaagaaatgatccgtgaggaaggactggattcaggagagtgctatgtctcagaagccaagtgaagaattaaagaaatgaagcatgacagtaaaacttatacatttatttctaaataaaaataatctattcatcaaaatagcacgacatttaatgtgtcgataaatatatttaaatttaaacaaacaaattctactttgaaatctaaattgagtagtataattgttgattaaaacactcaagagattatattcaaatccctactttatttattttacagtgccatgaacattcaaaagtttgacccaattctcttgagattccaaaaattattttcaaattcttttggtctttttatagtgtaatatgtatgaaatatcatgtttgctctggggtacagtattgtttttaatgctgggcactgtaaaaattctcaaattttagaattcctaagtatctgctttttgtttgttcttggtttatattttctgatgtcaaaggtctcatatttgcatgcctattctaggcatggattgtgggagtctgagctttaaaatagtccacaagaatcattttgtgatttgggctttatctactgcctttaattttaggcatcaattttgaagtcatatcagtagccttaccacttgaagtaccaccaagtaggaggctaattttatctaagaaaagtgtttctacttcctttgtttttgattttggtgaagacatagaggggataggaggataaagtagaaagaagtgatttggcaactatcctattagtttaaatcataattagacctaactgcataattcagaacccaagttgagtctcctagcagctcccttaggggctctggggctgtcccatcacagaagccctccactgaacttcctccccagttgctcccatgggcacgttgccttgtgtcagaagtcagagtatgtcttcttccagcttgagtttctagcttctaaatatttgtagcagactttaagtggcaggataagtggataaatgaggaatatatcacagagactcacaaaactgctcaggcccaactagtgcctatgttatcagctcctccaatctctgtacttttcctttgctagagacatcacacccacaactgcttttcaatgcccttgccacaaggctctgagttccatggggacccatgtcttatacattgttatattcctggtatctgacaccatatcaggcatactaagatacttttaaaataaagcatgagaggcccaaactaccttgtttaaaaaggcagaaaaaaattgtaaagaaggatgacaaggcgtgaatatttttcaagtcacaatcataaaaatttttataaattgttattgatatatagattatatataatctatttatattagattaaatataatctggcaaataaattaatgaatggatctcatatagtttattttaagtagaattcatagtactgaggagaagtaaaatcaccagatacaaaattaacagatgttttagtagcccaaagtgtggagtaggaagtatacgttagtccattctcacactgctataaagatactacccgatactgggtaacttataaaggaaaaaggtttaattgactcgcagttccacatggctgggaaggcctcagttaacttacaatcatgatggaaggtgagggggaagcaaacttgaacttttcacatggcagcaggagagagtgctagcaagagcagggaaaactgccttataaaaccatcagatcttgtgggaacttactcactatcacgagaacagcacgggggaaactctccctcttaatccaaccacttcccaccagggctctccctacaacaatgagggattacaattcaagatgagatttgggtggggacacaaagcctaaccatttaagacatcttagaattctacctacctcagtaatcttgagagacaaatatctgttattttcacctttgaggaaactaagatttcaaagatttagctgacttgcccaaggacgtctacctgagaaatgtttcttactaggaatgtccccaggagatattcggcaatgtttggaaacatttttggttgtcacaaatgggaagaagctggaaaacttttagctggcccaggttaaaattctattagcatgtaagaagaaaagaagatatcaaaaaagaaggagagaacatatcaaagttgcttcataattaatataaagtcagatgctccaggagatgtcaaataatttgcccatgatctgatgatggtcaacttactcaccattaccttgttctttccagtaatgataactcacacttttcttcatagcctaaatgaaaaagaataacataaagcaagactcaacaaactaagggtcttcttgatactaataataaattagaagttcaagttccctatgagattaacaggctcctttagagaaagcacattattaagtacatgtccttctaagtgatcaagatgtaagttttccttgcagtataatgcttttaggcggagaggtaacagactccagagaccggagggagacacaggatgagaaagggaggcaactgttatgatgtgctatacacaaatgtgtgacagtctcaccccatgaaggctcacagctctccagttccttttgatgactgcctgtgtggccaaagtttaaaatagacttagtataagtgagtgctgtgccacaggaggagatggaagaggatgagaaaattacaaagtacaatgtagacagcttagctaggaagatgatgttgacatagatgatagatcaatcgatagatagatagatataaaaatggaaaacaggccctttcctcttaggcactacattctctgggacctttttcaagaccatgtgaggtcagcattactagccccattaacaaatgagagacaaagaatgctaaatatcctgatgtaggcagcaaagcccctacctattccatctggcccagttgcctctataggcttactttgtatcactctctttctcattcattcagctccagccacactggccaccctgctgctcctcaaatgtaccaggcacatttccatggggcctttacactaacagcttcatctgcctgtggtgctcttccctgaagatctacagggttcattgtttttctttaggtgtcttcaaatgtcaccagttcctctctccctcttgatattcctctactccattccctgctttacttctctttaaaacatttctcaccatcatattctacatcacccatctattccaatcctgcccccaacaacaaaataacctgatgtaagagcttgcatgtaggcagtgtattttgcaagtaatgccaaggaacaaaaatgggaaaatgggaagagtgaaaagagaacaaaagcaaagctaatctagcagtgcattatcaagttggtgacaaatgtgggtaactagggctcaatatgattaggggtcctctgaaagtcctgcataacacatgtcagaattgtctaccagagttacaggcttctatctcctattctttaagggtaatcccatggctgtgttaggaaagattcagaatggctgagcgggttcccataagtgttccacacagaggaacgctagggcaaaagttggagtgaggtgttagctggtcacacctgcaatcagctagttgtggtaccaatgtctggaataaaatggtcaaccaagaggttgtgaggtaggatataagaggttcatgaaagagtccagcttttgcaacactgagacttctcccagagccttcaaggcagtgtggccagtactgatttctacaatagactcgataaagaaaagctatttgggaaagggagtccctgctaccaccaggccgtcactgatattaaccatcttttttcctcctccaatgtcattctaagttttccctattcttagtcaccactccagttggtctaaactgctttgtctggagagatggctcaaaccatcatctacatggggttagaaacctttattactacaccacagtcaggtcattgtctttacaatagtccgttttctgttatcatctggacagccccaaggaagctcctggtttctacacctgctcttccatggtaccaccaagcagcaccaccacgaggagcaaccatagctcctcattcaaatcaggctcagttatccccaccaacgtgatgacttccttctgcttttggggccacttgcatgagaagcccaaaatggccaacaatggtcatagttccaagactatgacttattctgtcctctagtgaagtatcctcctgccatggtagaaatcagaactcctaatccatcagagcctagattgtaggaaggagaagcacagacatcactagtaagtatgagtgataaccatggggccaatcttttacttcatggtttctaacccatgtattctagctttggggaggtcacagcaccatatgttggccattaatttggggcatacacacttcctgaggaaagcattccaagcctacatagtgtagtccctaaactggcacctcggccaagcccccaatatatcttcccatcattctttgaggaagccacaccactgtaggtaagacccagtacttttcaccattgtattccaacatgtagattagtacctggcacgttcatcactctgaatatatgaatgaattaatcaaccaattattctctttagattaactgagacattcaaaatcaaaaaacaaagaggttgaaattcattataaactcgtacctcacattattaaagcttgaggaatgatctcttagatacaaacgtaattagcttctatgatgttgaaaaataaaattaggaaaattgaaaaattcacactttcgtaatgtatgtggaattaatctattaatataaaaaccatacttatttggcataccaacaaatcatacacttggcaacataggggtacaaattcacttatttttctttgtcctgaacactaatgaatttcgtgtatgaaaaacttcattaagaaacattgtttaaaaacaaattgtcaaaacccgactctaccagattaaatgtatgttaaaacatttaagatgacatttattgcatcaattttttaaataatgcttgagaaagctgtgaacataacttcatagcccaaaaccttcttctctttccctttgtagcatatttctccgataatgtattttgcctactgctaccaaagtaccagaaaataatgcctaaaagaccaaaatgaagtgtttcagaattaaggagaaagttgtaaatttgtaatgttttagacacatttcagtttagcgcttgatagatcatgtcgggttggttgcgagagggatttcaagggcttgggaaaataaagtcagtgtatgtgtagtttcatttttgagagaatcactttattactgatcacaggacagttgttgagctctgacagctctaagtgctgaaaacattagagaaggtccatttttttgtttttgcccaattatgaactgtaacttggtgagagaagcaatagaatctatttacctaacctaatggtaatgcttcattttaactaaaatgtcaacacatagtggtctctgcacgtatttcaccagcatctaaattccaccatggggttcaaattttttaaatgaaatcttagacccttggtagaaaaagagccaaggatttatatatcaatgtaaaaatggcctatcttaaaatatacttatcacaaatataagaaattcctaaaatttggggttttcttctatggctttctcaaaggtcagaatgcaatgtttctattcaaatgaacaattcaactagttaactaatacgaagccccttttcttatcttctgctaacctctcacctttgaaatcagttgtctaacttcaagtgttgccttcccaattaatgaagttatctacacaattttcaaaatgtgactccatgtctatgagtttgttgttaatattactggaaagacaatataatgtgaaacaatagcaaaaagcaaaaattgaaggcactagcaccttctttgtgggacaggaaaactaacaaaacttggtgatttgtattaactcaggaccacagtaatctcataaaatggctctttcttggattttgcaagatggtttcattatttagtgcaccaatcaaaaagatagccaagtttttaatccaggccaattgaaagcaaacaatcaatgcaattaagaaactaggaaaaaaaggagaaattctgatgtccagcacatatattaaacttaattatatttttcatgataaagtaaatttgctcagtggagtctcaaagtatgttattgttataaattattttaaagttttcaaagataactttcaaaattaaagttataaaagatgactcccattttctcattttcctcctcagtttttaatgagcatacatttctcacttcatccattaagaaatgtttgtggtttaaaagttcatgttgactgcaaaaatggtgatagaagaaagctctgaggatattgctataaagttaataaatcatcttcactcatcaactatcttcaacccgcacaagttataaaggattattttgttagcaccacagggtacacaatttaaatttagagaatcagccctagcagaataagtttgaattctggaagcttctaggtccccttgcctttaaacattatacgcttcagagtccttacattttcaattgacagagaaacagaaaatcattctaacgtttaccgtagcttttccctctaagggcttcttgcaaagaatttgcatgttgcaattatacctcaaattagagatttgagtttccctgcctggtcaattataagacccttggccttaccagagaatgaatacacgctctcaactttgcaaaggtctgagtcaacagcttgttgggctttgaagaacctcagccgtttttgcggctggagctttttctccttttcgtgtttcaggaccactgctggttttcattcatcttcattcagtgggtttcatgtgacattttggggctggaaacataatgtgtcagaagatagctgcagcttcctactgcgttattgtttcctttgtcagaaggtgagtgagcacaaacattttccaattgctctgattttcagacaggtttagatctactgagccatcactgatgcacacgcctataccatttagaaacacttgatatagatttcagaagagatttctaagttcagttctatacaaataaatgtactatcatttatcctttttccagaagaggcagagatttcatatcctctccttggtttaccccgatcagtataaaaggaatagatacggtgcttcaaaaacacttctcatttgggttcaaaaacagcagctcacctttctgctggaagcaaaacattatcatgatcaacagaatctgtctgttgggattcagttctgcaatcctttcatggatcaaattcccatcagaatcagaattaagtcctaagtgaaaacttaaattacattataatactcagcctcataagttccaccaaggctttgccaaaggcattgaatgatttatgataaacttcagaacctcagtcccctcttcccagggtgtcttcaattaattctttgaagaactttactcttgattccttgttgaactgaagtaataaggggtttaaggcctttatatttttcctcgaactttctcttcttaacttagaatatctgcaagtgaaatataattgattggatctttctaaatctgtcttttataaaattatggttaaatattatcttattcctgcagaatttatatgacttttaagtataaatctctatgtcatcttagttataaaaatcatatcattagaaattgccaaaatgcattacacttcagcctgaagagtaaggttcctttcagttagaaaatagctccccaggaaattccatgttggtctgtatttgattccccagccgcttgggatgcaaatgcatgccattgactgtaataagaattggatgtatgtctataggtagactgtaaaattttaaagtttgatttgtctcctcatatggagaaactgaatcctaggaaaatttagagacatttcctagatcacacatttcattaaggttagtgtgggttctctttctattatggggtgtggcatcagaaaaatgtggttttaaacactgggtcaactagtaatatgccttatataagtcatggcatagtctacttagtgatgccatgaataacccactgagcttcatattcttaactagcatattcttaacttatctatattctaagatagctgagaagatgaaaaaatatgtatataaaaattctggccccaacacgcattaaatgatggtaaagattataattgttgatctttttatgtaactaacctcctaaaattatctttctgcccttttctccctgattcattcttcacacagcttatggattaactatctatagcacaggtcttagtatgattctctttactttaaatattctcaatggcttcctatcatcaatgaaattatcttaaaatttctcaccctaaattgcaaagccctgcgtatcaggctgcagcccacctttccaaaaatcattttaactgtttttctgtaattacactattttcatgtctagctaaattggtttacattccacagacaattctccaaatttctaaaaccaaaattccatctcccctataagcgctttatttattcttccaaccagatgcaacatttcccacagaagtggggaagagaaaggaaaaagcacctactgaatatattttctgtgcagagttctttcttctgtgctgggcactttaaatttgttatttcattagtgcttctcttatgacatgttatcttttgttataacaaaagacatgtttgttgttgtccattaaagctgtccattaagggcagaaataatgtcttaatctctagcatagaatatttacaagtagaaggacttagggggaaaatgcaaactgaacaccttaaattattatcaataaaagcactagccagaatgaggagttgaggggcatttgaagcaacttggaaaaccatggcagcttatttggggtagaaaggccctcttttatccatcataaatcatcatcagatttatactttgttagcaaaagggggctgaagtacaacatgtcatatagtgtgttgcaattgtaacagggcctcactcttctttcttcttcccaaggcctaatcagttacataaaaaaagaaagaagagaggagacgagagaagaaaagagaagacaagagaagagaagagaagagaagagaagagaagagaaaagaaaggaaaagaaaagaaaacaaaagaaaggaaattaccacgaaaccagtcctggaaaatgtaaaatgttacttgcatcatcatgtgaaaaagctcaaaagatggaaaaatattttctaagtacatttatttggacataacataagtatcttccaacatattttagcgatggaagatgtggtgaattgaaaagatgagttcagctctacatatgctttatggtcacaagttgccacttttaaaacatttatatactcttatgcatatcatataactgaacatgaatgttagcatctaagtatatgtatctgatgaaaatgccagagttataaaatcttttttatgtttttttaatcacaaaaatatcaaaatgcaccttggttttagggaataattttctatcactggtcctgagaacctctaaaattatggaacaatcgttccagactctcaataccattaagttcaatgaactataaactccagggcaaagaacacagcttttttgatcaacaatgtatatttaacgtccaagcttaatgactgaagaaagtaaactccctaaaaacataagtttttttttaatgaatcaaaagaaaaggaaaaagaaaaagatatttagaaaggacccatagtttgtcatctgaatgcagcagacatttaaaatggactctatcttttcaagaatatgaaatctactgacccctttcaaggggttcccccacctttcattgcctccctcagcagaggggttgctggatgccattactcagggaaacagttttgattccttcctgatcgcctattatctctcttgttttattgaaccagggtctctctgcaccctggcagaagctggcaattcatcaggataccatttagggaatcactgtgatgcttagtttacagtccacaaggcagctactgggagaatctggatcaatgtgttttatgcctctgaaatttgggcagcaaagaaagagtgcttcagttataaacatgcaatgtccatagttctcatcatccttctgaacaagcagaagctccccttttctgaacccaaatggagcaatccaattacaaagtcattaaatcccgttataaggtggttcataggagttcctgtttccagcaaaagccttttctgtgttcatccaacatatattctggcctcttgcactcagtttacaaggtttctaattaagctccagagaggatgatatagttcactgaactgagtcactatgctacaactgggaaagaagaggcattcctattttatcagaaaaataaacactttagtttcatttcctctgccacacatgttatctctttgtgctgtcacaacattttttataggtttttatttcaaaggattaccttgagattactgtcaacgcaagccagagagacatctccatacagaatataggggtaatattttttctcctaaaacatcctgctacagacaatataatatcatataatatcaccgaaataatctcccctattgagagcaaagagacagttttcaatagtactttggtacaaaatttgaggaaaataaaatgtttatcagtgacaaaaatacaatttaccagcttgatttttaagtcaaaaatttaaccttttaaacgatttcagaagctccgctaatttctactgttccttgtaacatctgtaggcaaaatacaacatgctgggtcataattcatagcttggcaagaaaatgttgcttaaaaacataaaggtccttttctttttatgcagaggaaaacattttagttattattcaactcaagtaaatgctcataaccatggaattaaatatttctgaagggttcattcctgagctttcttctgggttgaattaggctttctcagaactatacttcatgtcacccacatgtcttaagaactggtgccttctgctcagctgtgcatttttttgcagacatgccggatatctacgcagtaagtgctctgaaacttcaaagagacacagagcattctgtgctttctcttcccaccattccatgtaaacaccatgaataaccagaccattcttatgccaaaaggccctgatggcttgactttttggtccgttaattgttcacaatcactccttgcctgtattgtgcttggtaggaccacctttctgcagccaaaatccagccacttaccactgcatatacttcctacagcagaatagatactgaccaaagcctagtagaaacctgcatggcatcctgtctcttaatacttaatgctaccatgccctcagagtattcttattcagaatctaaacaagcatgtattcagaggctacaatgtatcaggcattggtggtgttagcagtcatagttcagtgaatgggaagaaagataaaaatccatgcctcccagtgactttaagtcctggtagggacaaatacagaagataagtaaataaacaagataactgtagatagtaataggctctgtaggcaataaacctcaggataatgtgatagagaatgacttggggattggtaatacccagatggggagctggaacaccgtccagggcagatggcatttgaactgaaacctgaaggaaaaaagaatctggacagcctcaacaccagatcaaacagtttttgaaacatagaaaacaagaacaaagcccccagtgggtgagaggaactgaagaagcctagtaggatggaagtataatgatactcatacactggagaatattgctaagcgcaaacaattctaagcttgtgaaagttccttgtgattattctatatttctttgaatcatattgatgaaaaattctttgtaataattcccatccaaatgtgacttcttgggtgcaaacataattttcacaacttatttaaaagcctatttaactttgcctatagcatgcttcacagaaatagtaacatccatcttacaggactttcatgaagactactatgtacggcagtcctcacttttttcctgctcaaaatcctgtctccctttccttttaaaagaacacagactttgttcgtgaccataatgtgttctccttaaaactacatgcatgcatgcattcctacacatatacccacaacctcaccactgcttgcagctagtgagttggcaagtatggcacacatagcacagagatactaatgagatgtgaatagaagatagatcttaaactcacgcattgtatttccctttactgttccctgtctggaaaatgaatgtgatgctaaaagaaaggcagccttctgtgaccctgaggtagctatgagaagttgcatatttggaatagttgaatggacagcttacaggagctgtgttctacatagatacatagttgtatgtagccaaatgcagaattatatgtaaagtgccacaaaacaaatgtaaggtaaatagtagtgtaaggccttcattatcatttatattactggtgtgttttaatgaagcattgaatttatttacagaaaaggatgctaagctgagatattttaaagtcaagctatataagaatttgaagggatatttaatataatatctgcttttccaccagccatcaatctcagcaaactcacacaggaccagaaaaccaaacactgcatgttctcactcataagtgggagttgaacaatgagaacacatggacacagggaagggaacatcacacagtggggactgttgcagggtgtgggggcaaggggagggaaagcattaggacaaatatctaatgcatgtggggcttaaaacctagatgacatgttcataggtgaagcaaaccactatggcacaagtatacctatgtaacaaacctgcacgttctgcatatgtatcccagaacttaaagtaaaatttaaaaaacaaataaataaaaataaaataaattaaaaaaaaatctttttaaaaagtaacacacctagtagctatttacttccataactattgtattttcttgccgtgccaaaatatctggcattgtaagaatgcacaattaaatatcattcatttactgacctagtatattgccagcaaagaacatgaagacatattctgctattgtttttctttctaccactgatggtggcaccaggcatttctcctatattccaaataaataatagaaaatacctttgcagccatatgagcgtttggaaattatcctagcaatctggcaagagcaaggaggttgacctggcctgcaatgatacgaacttaggggctccttgtggcctaaacttgtaccaggacaattctgagatcaacgttaccactgtcaatgagatagaagtcttctacacaaacaaatgtctgctgctcaaaggcctagtcagtgtacaccatctcccataagaaacttcccacaggaatctttagtaaacaactaaacagcactatccacaataagcagttgttatttattaatgacctattatttcaccaaacttatagtattaaaattgtaattagtagttgctatccattaagtacctatgagcctagcaccatacaatacagtatacattgtccttaatcttcatattacttaataatatgattaataatccccaaaatatgtaaaattaattgaattagcatacataggaaaaattcaaatgcattctaaaatttctttattaaaataagctagataactatgtggtcaaaatgctgtcatctattacctacgttgacttattgatgaatgtgtgtagatactttgtcactgggtcacttatgtcttgctgcttatccatgtctgcagaattttgcagagttcttccaggaaccgccaggctttctcaggataagatatatcagatgcattcagtgtgatcagacacattggggtacatttcacccagaggtgtacctgctgtttgtaatgctgctcaggatttgtgcctacaaacatgggaattctgataaattctatcttacacaattcccataaaaatatatgttgtgggattatggttacacttatacttttcaggtatattcctaataggagagacccatcattttgactaggcatctacaaaaacttaactctacccctgtcccttacaatttttcatgtttaatgtttagaagagttttcaacagaccatcttctagctccagatatttcaccttttctctgccactacccaagtatttttctatttctttaattttttaaattaaactttttttaagtaaatcatagatccacatgcaattgtaagaaataatatagagagacccatttcttccatatggcaacgtctggcaaaactattctataacatcgcaaccaggatattgatgttgatacagtcaagattcaaagtaccaccatcaccacaaagaccccttatggtgtccttcttccctcctgccagacccacttccctcctgcccccacctcctccttaaccctggcaaccaccaacatgttctctatttctatgtttttattttttcaaagattttatataaatgaaatcatacaatgtgcaacttttggtgactgcctattttcagtcacctgaattttctggagcttcatccaggctgctgtgtatatgaataatttgttcctttttattactgagtagtattccatggtatgaaaataccgcccaactatttttattgccaaactctgtagttcacattcatatcacaacatgacctccaccccagcaccttcatgacatgatgccaagtaagtcaacttagtgggcaaaaggaatgttccttacaggtattcaaattcagtttagcaatgcccgaattatatttggaagtttttaaacattccaaacttcatctccaactcaactttctcttagtaaaatgcaaaagttaactaatttttaaaagaaagaaaagaaaaagaaaaaattatgttgccactccaatcctgcctgatatgaagggaagtatggcagaggggaatacagcgtggaaagagacagtggtctcacacaattatggttaaaatattttacacttataaattatgtagcagtctgtgctcagatgaatacatggctagggcctcttttaggaatcttgaaagaggtcagaggaagcatgggacctggagcatagggctctttagaataaacctgcttcaactttcaaattgcctatatgttaacaggatctctcttgttaactggagaagctgccatgcttatctcaccaggcacaaaaatgcttccagccaagtcttcacaattgccctgaacaggtaaaatgaaagatacccacacttgaggctgatgccccagaatacaaattattaatgggtacaagacctattaatgacttgagtctgtagagagcacccagaaaaagaaagagctcttgatgtctcacataaaaagacgttttaattattgaacatttagtggcaggggtgagggaaggggagtgtgggagggcccaggtggaaagcagaaattttcctctacgactctctagcaacagcaactgccaatgacaacagcagctatgtgttgaacatttgttctgtgctagtactgtcaattcatttaagtcataaaacaattctttgaggcaagtactttattatgtccatgtttaaaagtcagacttattaaggtataatttatttatcctttttactgcaagcctcgaaatcaggtagtgtaattttgctaggtttgtaattctttctcaaaattattggtcagtcttggcctttagcttttccatataaaatgttatatcatcttatgagttttactaaaaagccttctgaaattttgactattgtcgcattgaatctttgatgaatttgggaataagtgatatcctaaaaatattgaatcttcttaaccatgaatatagtatatgtctccatttatttgggtctttaatttgtctcagcaacattttgacatttttatcaaacaaatcttacagatacattgttagatgtatatctaaacctctcatgactttgataatatttaaatgatatctccaattttcaattgtttactgctaacaattgatttttatattgatttgtttactgtgaccttgctaacctcattttattagtcctagtagatatttttgtaaattccttgagattttctatagaaagaattatcctgtttgtgaatagagacacattcatttatttatttttgatctgtatgtcatttatttatttctcttgttataatttacttggtataacctccagtgcaatgttggaaagaagtagtgagagtaaacacccttaccttatgcctgaccttgggaggaaggtattcattctgtcttttactattaaatctaatattagctgtggactttttgtagatatcctacatcagattgagggagtttcctactattcctagtttgctgagagttttatagttgaaaactattttcaatagttgcataattcattgttaactagaatatggtctatgttggtgagtgtttcatgtgtacataagaattatgtgtttcctgcaactgttaggtggagtgctttctaaatgttaagtagattcatattatcaagtaggttagtgttattagaatctgttatccaggtcctctatattcttactaaaattttgtctactgattccatcagtcaattagatagcaaagttaaaatatccaaccataattgggatatatctatttctcttttatgttttatcagatttttgctttccatattttgaagcactgttatgaagtgcatacaaatttacaaattattattttttcttggtgaattcgcttctttatgttatatgtctctttacttctgaaattattgattagctattacaatatatttttcactctttttctttcaacccatctatgttgttatattttaaggttttgttttatagacagcatatgatgtatttctgctttttgattctatcttaatatctatggtttttaaccctttattatattgctatttgttttatttttcctttgtctaatctgttctttttagtttttctctgttttcttctgctgtattttattttatgactccatcttattcccactttggtttattaggtaaacatctttattttttcaatttttttaatgattactgtaccgtctaaattatatttttaaaatttatccagtctatcttcaaatgatatttctccactttagataccattagaaaccctgaaacagtatacttttatttcatccagtccattctttatgaagttgctgtaatgcatttcatatctatataagtgataaaccccatattgaatgttgatattttttcttaagtttttcatttttttattaaaacagttcaaaattaaatcaaattcttttgtatttatcttcatttttaccacttttagaactctgtatgtcttatgcagatcaaaagtttcacctagtattatactcttgcttgaagaacttactttgacaatgcttatagtacaggtctacaggcaatgagtcctctcagatttgttttgtttattttttgtctttatttttataaagatatttttactggatagcaaattctgaattggcaggtttttcccctccaagtactttaaagttgtaactccattgtattttaatttgcatgatttctgcaaaaatatttgctattgttcttagttttgttaccttatgtataatgtgttttgttgtttttccttttgactgccataacattttctctttgttttggtttgcagtagtgtaagtgtaatgtgactaggtatattctattttatctatctatctatctatctatctatctatctatcatcaactgatcaattgattgatctatacttatactgcttgggatcacctgggcttctggaattgaaaatttgttgactttcattattttagaaaattcttacctagtctcttcaaaatttattctgccaagtttctctctcttcttgtctaggactccaattacacacatattagactatttgacattgcttcatagcagctggatgcaccattatgttttcttctctttatgtttccattgatatatcttctagtcaactgagtctattctctgctctgtccagtttgctcatacacccactgaaggaattttttatttgtgacattttatttttttattttgaccctttgcacatgacacatatttcatatagttttcatctctgctgaaattactcatttgcttacatatgtataacatctatccacgaaatcctttaaaatattaaacatagtttatttaacgtttctatctgataatgatgtctggatcatctataaatctggttttgctggctactttataccttgacagtaggttgcttctccctcaatatctctttctctctctctctctctctccccacccctgaccaatgagtatgtgtgtatcttgtaatttttggtttattgctgaacattgtgtttaaaataatatagactgaggtaaacagtctttatcctggaaaacaggcatgccttttattttctcatgccattcatatgcatgtcatgttgggaaggtttagtcagtctaatcagtttttgagcttggtttgtgttttgttattgccatggtaaccttcattccagcaataacttcacattccactagcatttcactgtcgataccttgtgcttaattggattttgtcataggaggattttcccctgtgttcttgctctattctcaatttttaacagtccttgtatgcttatgccatttaggagtatctctttatactattgttctgtcttaattattattttgcacattgttcaaggtgtgatgggtaaagtgggtagttttctattatcttgacccagcctcacacttacgtaagtcctgggtgtctagaccttgagaatggagctctctcagtgttcctgcccatcctcatggtagccaaatgtttcccttatttctgtaggaaggtgggggagctgggtgggagagaatactgttatttccccctgtgcattgtatcatctcaaaatcctgggtcctagcagtgttttttcctctctctcaaggaatatagattttgttttcattcctcttttggttccaatttacccctgcctatttctattggcaggggttttcttagcacttctgcagtagtacactgctattgcttattactcagtacaaaccttctggttggaacaggcagcttttgcttctattccttcctcctttccttttcctgggactggaagtagttgagtttttaactcctcctccagaagcaaactactttgcttttaccttctcccacaggcagtagttctttgccagggtgctaggagaagaaggagttacccaccccttttctgggatcagaaaaagggagacaaccagtattcatttgagagaaatatgaagatgcaccattgagggtgttcacttagttttcctccccttccctgaatactttctgtgggcacaagtagggcctgtaaatttaaaaaatacttagaaagtacagacttcacacatatctgaagtcctggggattctactctatcatattaactttacacttggccttttaaaacgtgttaaaaattttggctattttctccttactggctgtaattgacagtcacctctttctttcataatcttccaaaggtgaaatggtttatttgactaatctctttttggagggagtttctcagcctttgaaaataagattctgtgattagaagccttgtctctttattttttatttttatttttttttgagacggagtctcactctgtcacccagtctggaatgcagtggcacgatctcggctcactgcaagctccgccttccaggttcatgccattctcctgcctcagcctcccaagtagctgggactacaggtgcccgccaccacgcccagctacttttttgtatttttagtagaggcagggtttcaccgtgttagccaggatggtcccgatctcctgacctcgtgatctgcctgccttggcctctcaaagcgctgggaatacaggcgtgagccactgcgcccagccgtctctttaaaagagtaatgttttcacagattttgttgttatttttgttggtagagtaaaatgacattctcttgcagctttctacatttttagcgaaaagggagacaaccagtatcattttatatgagaaatatgagacttggagaggccaagtaacttgccgtgtatcgtaatctattaaatgttaaggccaacatttaagctcagatttttctgaaataaaagcctattgtcttaaacatcacactgcaatatatcttgtgtaatcttctcatcaaaagtacgtatttgaggtgtctaattaattctagtcagacccaactgttttcctttttattccaaatgagcactggaagcaatgttaaaactattcaacgagtcaatacattttctatcctaagtgcatctagagtacaagattttttttcttcttcaggtgagtatgcctagaaaatctaagcccttctctgatacctcagccattttggaaagtaaatgctcagcacttttgccattattaaataggcttgggtaactctaaaaatttctactagcgctgccttgtaaaaatgcacaggcaagcccaatgaggacatcatgtgatcacaggagcttgagcttaaaaagagaggacagcttcagggaagaagaattctgcatcaaattggggaaggcaatggagaggcaactcggaacagatggcacaacagaaagtagcttagtaggaactgatattgttaccagagaaagtatcaaaatcaaaggcagaggcaaagatagaagctagagcacagagaatggtcaagaaaggaggacagaattaggcttttgaaagaggtggaaaagtggtttggaagagatctacaaatgtaaaatatatccttctagtcacctgcagaagccatcctggtagttaggaacctgtgagagtctgatatgcagccagatggccctcacaccttggccagacatgtgtttatacagtaaattctatctcataaaccactttctcatgttatcttatttgaaattcatggcaatcctatgtagcagggacagaagatattgttagttccatttaccagatgaaaaccctgaaacagaatgttcataattcatcagattttccaaccatacctgcactcatagatcatgacataaacaacaatgctattttttcatcagtctgatcatgcatatttatgtgtgtatatttacttccaaggtgtctacagagttgcacacactctctgaatgttgctaagatatataaatgtggttacttttaaaaatcacaagaaatccattaatgattcattccatttaacaaattacaacatgataaaagggaagaaatttaaaaggaagaattctctccaaagttcaagcaacaaattttcatgtgatgttgggaaaagcaaaatgttttacagcttttagaggcgtaaatcaaaaccttcccactaacacttacaaccattttgaggttttattaaagaaaaaaattatctgaaaattcattacttggatgataaataggactagaaagaaagaggaaaggcctgcatgtggtaagtggaaggcattgatgaatatttggaacattcttttcttaagcccctctataaactgttttcctacatcatctttaaactgcacagatgggttcatgaatctggctccctcactatagcaggacattcttacaggcagggtctggacggattcactttttatatcctaagtgcccagcagagttcctaaatgcagtaaatgttcactaatatttggtggataaaaaatggtgccatcacaaaacacacatatacacacaagtacatatactcacataatagtagcacccataccattccataaatgtatacacttttatatatacctaatccatatgtatgtatatgcacacatattttcatctatataatgggctatatatcattataaataatacagaatcatgtaggtgttgttgctatgtgagtatgtgtatactcatataaaagtatgtttcatgcacttgtgtgtatatgtatacatatatgtatatagtcattttatctttgaatttttcacattatattttaatctcaaataagctttagtgaaagtgagttataacaatgagaataactgattttagtcttgactaatgagaatctcaattaaaaatgtaagtctgaagcatagcatgtcaaatatacatatgtttatataatataaattattttggaggtccccgatacttttcattacctgatcacaattacaggtaattgaaagttattagaaactaagcataaagctgtgcactcccgacaccacaagacctccaacccactagtcagctaaaaccactttctgatatactctgcacaatgaccctggtggctgtcagctctttcctgctttcctgcttccctggaacctgacagggccccagtgatgatttacctatgtcatgttatgtagtccacagcttgactgaggtcttgttctgattcacagcggagtgttgaacaaagtctgtctggaataaactgaatgcattcaggaaaatttccttctcgttcattcatttatttcctcattctcaaacattgagcatctgcaatgttacagatactgcattaaacactcgggtcacaaaagtgaatgaggcacagtccctgtctaactgctgctgaggtttccacagtgacattttcttaaaccccaacttatacagggtgttttcagagtgggattgtacatgttccaaacccaagtgattttgtttaataattttgaccatcaaaaatccagtttgaaaaatgaaccagaatacaaatatacaacatttaatgacagagaaaaaataaaggcatacagttttttaaagaaatatttcatcctttgaagaatactgagaaatctgagttcaaaggtgatgtgagcatgcttcaatcatgactatacacaacagaatctgtactcagctcagtattggctagagaagttctctttccctcatttaagccaagaccagaactccaaggctgaggcttgacataggtgtactgtaaatgaagtgttaatgagatggaaattctccaagttgcttttgagtctcactctatatcagtgtagacctgcctaaaatatgtaagagctgagaatccttttgaaatgattccaaactcttgagtctgaaaaccgagctgggaattcctttgtaacagttttgtgggttattttggcactttggtttataatcctagctggaccccatctgaagttctaaagcccataaaataagaatgaatggacaatgtaaataagccaaatttgagaaacttcagaccctgcttggctgaatgtttctgttaatctaccttgtctgtgctggtagaactgccattttgctataactcctttgtaaataagaaacttttcttctcatcaggcaggggatctttctcttcaaaggctgtgatgtattatactatattgaaattaaattgtttggatatgttttgctgaatactgataaaactatgatataaagcgtattatccttaatcaaaggttacttttatttgcagattttaaaggcaacaaaaatttttatttgacaggttctaatagttctagtttggcatacctgcacatttttattgtatcctgggaacaggcataaatcaactgatttcccacagacaaataaaagtggtggagtaatatagttcctggaatttaacacttcatggtcaggaggtcacatatgctaagttgcttatttacacgcctcttaaagtttaagtctgtgggcaagagacatgaagcaatgtgacttactatatcaatgaagaatgtattgttctttttcttcgggtagataaaattaacagtgttggaacagcagatcacacaagaatgtcatcagaaacatcagccattttttcaaatgtgcttgcttgatgattctctttgttattacaatcatcagttttaaacaatgagatttattaaacatttttttaagtggggaagagagagttagtgtgtaccaatcattgacatattagctggcatctcgaagcctaaacttgcagttaggccaatgtagccagaatggaggtgatgcagcaacccaggtgcctcctccggccctcacttttgctgccaaaactgatcttacagcccacatgttacagatggtgactgtaaactggagagatagccatttgacccacatttaactatgatacaagataagcgatagttattttcacagctttccatataaaggattttgatgagaacaaagttatatacaaacaaagttcatttacgcaacacaattgtattgagatcccagtatgtaactagtactaaacacttcttatacattattcccttttcacatgctcacccatttaaaatttcacagcattcttcagatcagtatattaaggcttagaaaagttttgacttgctaaagacacatagttagaaatcaaatgagtcaagatttgaatccatatctccctgctcagcatctacacttttcttcgctggagagtacattggaagcctaagctgatcacattccattaaacctcaagtcattttgagcccaaggcttcagtttcttcctttagaaatatatctcccttcaaatatacctggaatttacaggtgaaacactggcaaattaataaaggaaattacatcagtgccctaagaaaggcaggccaagagtgctggtaggaaccatagaagcaagaaaacccctgcagctttatcagagtccacatgcagttacttattgcagcatttaaagccttaaacccttgtcccttacctggtggcctcactggatccagcaacaaggaaggaggctgggcatggtggctcacgcctacaatcccagcactttgggaggccgaggtaggcggatcatctgaggtcaggagttcaagaccagcctggccaacatggtgaaactccatctctactaaaaatacaaaaattagctgggcatggtggcacatggctgtaattccagctacttgggaggctgaggcaggagaatcacttgaacccgggtggcacaggttgcagtgagctgcgatcacaccatggcactccagactgggcaataaaatgagattccatctcaaaaaaacagcaacaaaaaaaagccagcatggtacgcctgtaatcccagcactttgggaggcctaggcaggcggatcacctgaggtcagcagttcgagaccagcctggccaacatggcgaaaccctgtctctactaatgatacaaaaatcagccgagcatggtggtggcacgtgcccgtcatcccagctactgggttgggaggctgaggtaggagaatcgcttgaacccaggaggcagaggttgcagtgagccgagatcacgccaaggaaggaggtagaaggaagggttttcttccttccatattaaggaggccaactgcattgccaggactctcccggaggcaaactgaaaaatgaagctctttctgtttttctatgcaaatcgcaatgctgaactttctgagacctggcataatgcagtcacatgtcttgtttttgcattcagaatattgtcttttcatagtctttcagaatatgttaaggaggtttcactatatatcacaaatcatggtttaaatttcaaagcattagataaaaatgaccttacactgcatttgtagatgtcactctcaagccatcccaatgtagtttccatgggaactaatgtacatcaaagaagaaagagagagaaagagagactgtaagatcaaatttttagttcctgcctcctctttttctgggaaaaccaaaatgagccccatgttaaatgctgttgaaattagatactgaatcttatcttctatgtgaatgcagctttttgtttttttcctcctaagaaggagtactacctatatggtcatgcacaatttttccatagagtccatccatataatttataagttgtatttacagcctcagaaggcacatgtgcttatttaggaggagagtcaacatcatccattattactttgttttcaagttgctttcagaattattattattacacagatttacaacttgttgagaatccactctatggcaaccatgagtgaaagtggttcgtgaatgaaagtttatagtcacgtaagaacacattcctagattgtcctctgttggtgtagtgtctttcatagtcatatgccagacagtgtaacatgagtagctgtcattagcttcccatccaaaaagaacagttaccaaacagtattgttaaaaagagcatgttacagctattattctttttttcttttttttgagacagagtcttgctctgtcgcccaggctacagtgcagtggtgccacctcggctcactgcaagctccgcctcccgggttcaagcgattctcctgcctcagcctcctgagtagctgggactacagtcacgtgccaccacgcctggctaatgttttgtatttttagtagaaatggggtttcacagaattagtcaggatgctctcaatctcctgaccttatgatccacccacctcagccttccaaagtgctgggattacaggagtgagccaccgcgcccagcacagctattattcttaaatccaatgccacatatcaaggccaactttatctacctctgtctcataggactcacctgggttataaaataaattcaatactttaatcggggggtggttggagagagacaatgatatattatattctcaattataattgagaatggtgatataaaatgtatttgtagcctgtagataattaactagaaaaacaggtgatcatgtggtttaaaataacaattaatttaagaacttaaaataaatgtttttaaaaagatatataatagtattatatgtcttaataattatatttattaaatataataaatattactattatactatatttacaatagtatatactattatatttatatttataaatatgttatataatagttatatttatattatatattatattacataataatatataaatataaatataataactatattataaatataatagttataaagacaatatgacaaataaatattaaccatttaatttatatcagtcactaccctaaggattgttcttttatctaatacattttattctaataactctgttaattaggaattcatgttcccatctaacagattaagacattgaaggacaagaaggtcaaataaagggctgaaaaaaatctcgtaacttctaagtgaaccaggcagtttccaaaacctgcctcttagctattatgctataaatatttgagaaaagtatttacattgacaaataactatgaagtttttagaacttatgaagatcatggtgaagaaaaaactatttgtaacattaattatcaaattgtttattcctttctgaaatcatttattcaatatcatttatttgcagataataggtaccaggcattgagaaattcagaatgaataagaaaatggaataaacaaagggttataaaaaaatctaggatgggttattcattttaaaagagaatggagcttaggtaaaaaaaagcaaaaatatacacaaggccttgaacattctaacataatgagcaagtcataccctgccagatccatgagagtggatgacaggatgtgctggaaaggaacatgggaagtacctaaaatgaaaaggacctgaaatgtaattctaaagatttcgtctaaaagaaatggcaagttggcagataatttttaaattcaagtgtaaataatctgataagtattttagaaagctgactggatggtataaagagggtggattagagaaggaaaatatgggtggcagggagatctatgagggttttgtgatgggttgaatggtgtcctcccaggagatatgttgaagccctatttttggtacctgtgaatatgacttcatttggaaataggatctttgcagatgaaatctagttaagatgggttcattaaggtgggccctaattcaatatgactgttttccttataaaaaaaggaaaagacggagaaacagggagaagaatgccacataacaatgaaggtagagaatggggttacacagctacagaccagagaacatgaaggactgtcaccaacaccactgctaagagaagggcacagaacagattctcccgcagagcctttagaggaagcaagaccctgtcaacagcttttctgagttctagccttcagaactgtgagagaataaatttcagcttatggtactttttatatgacagcccaaggaaactaacacaagtattggtggaacacttcttcaacaaatagcacttgaattaaggcagcggcactaaaaatggagaggaggaggtatgtggtagaccagggatatatttgctaaaggacaaacgaagtaatgagacttagaaacagaatgatggagccacaaagaatgcctgaaatggtaataggatacatgcttgaatgttgatgggccccatttccacaagcctccaaatctgcttctagatcccattcgagcaagggaggatttgttaagaagaaaggccttttgagagcaccagtccctccaccagccagtctagtcctaagagctctgaaggccaaccttggaagtggtttaggagggaaaatgtaggacccaggatttcagttgccaagccggagagcaggggacccaggaaagaatattggcattcacttgatttttccatcttctgatataaccttcaaatgttaatagtgtgtcgaagaatttattggaagtgagaaacaagaaaacagtgagtctaacctagtcattctagaattgggaggtaatagaaaagagagaaatgggaaagttgctcaaatgcaagtccagtgaatcagagagaaaaggctcaaagcagcagaacaaagcttcaataaagagatattgtgacttggagagatggccttttgtcctttgttctattaccggtcagagaatggggagcacacccaagcctgagacaacagctctgctaagtgcccttgagagggcacggtggggtcagcaccaaagccagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaattaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccctcagactgtgtgttctgtgacatcaaagactggcaacattctaaaggtaaatgtaactatgcatccctttgggattttcagatatcttgtacaatctattttattcctctaaacatggagactataaagctgtgtggaaatcaatagtttaattcattcattcaacaaacaggtggtgagtgctcatcataacaaccacatctaatagctaacatgttgaatgattatcacacatcaactactatgcgaagtgcttttcatggtttatgtcatttaagtatcacaaataatactatgagataggtgctcttgttatgtccacttgacagatgaagaaactgaggcccaagtcccagtcctaagatgaggcagagctatgttagaattcaggtaatattactcaggaggccatgtattaaacctctttataacatatccctgtatcatatctgcattaggcatagaagactcaagggttatagggtttcagagaagggaagggctgaagggagttaattaggacaggctttaggcaaaaggtgatacatgatgttagctttgaagaagaggcagatttgagtcagcagagcgtgaaatcaaaggctcccaggtaaggaatgggaaagcacgtgagtgtagtccaaagtcaacataagacaaaaggcattgtagataatgaggggacaatttcgaccagaatggtgaccctatgagcagtaaaataagtccgagaagattgagttagccattggagagaagtgtctgacatgttggtgttggaaaatagaaaatcttggtggttttcttagtctaagcagtgttgaaggtaacagcagtggtacacaggatgaattacactaatagaaagcctggcacccaaggatttcagctagggtttgtagaaagatagaattatatgagatgtgttctaaagcaaaagtgataggacttgttctctgtgacatattgaaataaagtatatgaactgattataccaacaataactaactttattgagcatatactgtgtcctatagtggtttacatgtaatcatagattaattctcataatagcaccacgatttagaattaaaggaaggcccgttctaatcctaggatttctttcgttatctattgaagacaatgaaaacagtaattctttaaataatgttgtgttatgggggtattatgataccattgacaggagtgaaatagtttggaagtttaggagcagaaaaggacaattttgactgaaggcaagtaaaccaatcaggggcagtgtaactcattaggtcgtcataataataactattgttattattatttattttgattcgactatgaatcaagatgtcctgcagataccaaaatcagtggctgctcaagtccctgatataaagtagcctgccttgactacccttctttttataattataattattattacagctaattactgcatgcttattatgtaccaatgttctaaacatttcacatgccatagctcagttaagatagtaataattatagtgttcactattacaataataagagtttatatttacagtgctgatagtgttccaggcactgatatgtttttaaatagattaactcatttaatcatcacaaaacccacatgaagtagatactaatattctaccttcactttacagatgaggacactctggtccagagaatttaagtaacttaaccaagatcacaaaactaatgattggcagtgtcaggattgagcccagattctctggctgtagattctattctcttaacaactgctctacaaaatcatgagctttggggtcaggcaggtctgggttgcaatcccaaccttgttaacttactactagtgagaacttcggtatgctccttttttgtgtctaagtctcagttttcccataagcaaatttcaagataagataacaatagtacttttcatgcaataattcctatgagattaagctctcctacccttctctgtgcttattacattgcttcaaaacaggaagtcttcggtgtgtgttttactaatgaatgaataaatgaataaagcacttatcatccatgctgcacaattaacattttgttgtatgctactttatattatttaacttttctgtgcatgtacttttcttgtcaatccagctagattatatgcaccctaggactaaaccacatgctttttactttaatatgtacccagttctctgaacagtgatgtgcacatagaaagcttctcaataacgatgactcccatgaatgaagcatttactatggcctagacattgtgttaagtatttagtcttcatagcgaccctagatagtaagtactaatgttaattccaatttacagaataggaaactatgccttagtgagctaaagtgattttccagtggccacaccattagtccatacagagtcagattagattgagctctacttatctacagaagtcctgggcttgatcaccatgctgtactagcttggtgttaaagccctgattgatgggtaatttgacaagaagtcagagcccattatcacctgcctttggaagggaatttcctgcatctgaagttcttgtctatttggcccacttggctcaaccacctagttcacggcttttctgtagatttctcctcttagcactccctcaacaggcacaaaccacatatccaagtcagggatgccataaacagtggctgctgctgtggctggcccacagagcatggaagcaggaatactcatgagccccctctgtcatctcagtatattatggcttcagcattctctttgcttaacaacctctggctgatccactgtgaaaattgtgtgcaatagtcttcaaaatttctaatttcatacctgtggtgaagtagccttgcggctggtcaaagagaacacctttaaagctgacagtggaaaaagccttggctcctaaccttctgcaaaactgtttttactacttcatgcaagctgttattggtgtctttatttaggctgtatttcttcatttcagcgtctatgtttagcagttatataaaggagcgaaatgggtttaatggcctcaagtggcaaagcagtgacatgtggtccttcttggagcaacaaaaggtcaaaagactgtggaggagacttcttgtttcctggtgactaggagtcaaatttcttttatctgtctgagtcaaggggaaatgatgttcctttgaaagtctcatcttgtaggtagagtgtaacagagtaggaaggtagggaaggttccttaaagggccatgcagataatctcatctgttgatttgtcctattgtgggtgatacagactcacattccctttctggagaagggagggttttaattaaaactaaatagatatccactgggtctgggtatgtacataatctagaaactgtgggcttctcaaggcctctgcattcagcatctcaagaagtcctatgggtaccaattgatccatcctggaatcactctcctctgcttgcatgggacttgcctttctgccctccttccttagcactcccaccaggctaggtatgagccccgagtaaggagccctggtctgattccagcttctttctcttattgactctgtgatttcaataagatatttgactttacaagttctgcgtcttcatctgaagacggagactataatgaaaatacaaaccttatggatttattgtgcagagtagaaggacaaagtatacaaaatgctttggataattgttatctaacatcaaaatttaggttcacatacctgatgcacagtaagccaaacactgacacatcagcataaatgtttattcaatttggccaaagtgagagggcaggaaagacagtctctaaagtccaaccttcctttacacataactgggggcttctatgagtcaggtaggtatacaggaaatgggataccccaaagaccaaagctgtttatgtctcttggcctgatcagacttctggatgccatcaaggtttgtgtgacctaaggttcatttttcttctccaaaaaaaatacagtttatcaatcttgcaggccaggggtgtaaggatatgaagttactagtgactaccttctaccaaaatgactatgtgcaagcaagcatgcatggaggcagaaaaaggcaaggaaaagagaaaactaagtaaaacaaacatcttatgattcttataataaagactcagttacacaataacgttgtgcacactaaaatcccaatgaatgggtgctgttagtataggcagctggcatatttttccctagaccaatcagtcttgtatttctgtttcaaggcagcctgcacagattctccaaagcaattctcagcttattcatagtagaatcaaaataatcaggtgaaagaaaaatttattcataaattcttaatcaaagcttccgctgtacccaccctgaagcagtatgagcactaaaaccatcctatttctttttattatactttaatttctagggtacatgtgcacaacatgcaggtttgttacatatgtatacatgtgccatgttggtgtgctgcacccattaactcgtcatttacattaggtatatctcctaatgctatccctcccccttcccccctcctcatgacaggccccgatgtgtgatgttccctttcctgtgtccaagtgttctcgttgtttaattctcacctataagtgagaacatgcggtgtttggttttttgtccctgcgatagtttgctgagaatgatggtaaaaccagcttatttttaccatctattaaatgggacaaaaacttcaatacttctacagttgttgtatacaattaaataatcttctaaatccgattgtccctccttctcttcttctcctttgataaacaacacacctctctgcatagagcaacagaacttccttttgattctggcccacaacttcctatgtacacctcgtttgtaaagaagctcatctaaagtcaaccagcaaacgatgggccctccaactctgatagcctgtcaccagccctaagctgccaggcttcctttgagtgtctgtcattggtgagatatagggacgtgtgaccattttgccatggctctatgttgctgaaccaggtgggggtgtgagtggcagtggggcaagtggatccttttgatcattagttatttttgagtattgactttaatttgtaaaatttcccatcttaatctctgccctagtctctaagcagatcccagggcattgaggagagttcaggtatgccagcatgttttggtgtttttccaatgccaaaataatattttgcccactgaattcacaagtgttttagatggtcatccagtttttgtattgacccctcctaaagaggtaacagttatcccttggtatcaatcaaggcatggttccaggacctcccttggataccaaaatccatggttgctcaagtccccaacataaaaaaggtgtagtatttgcatataacctacacacctgtgtgtatatttgcatataacctgtgtgtaggttctcccctttcctttaaatcatctctagattacttttaatcctaatacaatgtaatttccatgtaaatatctgttacactgtattgtttatggaataatgataagaaacaagaagtctatacatgttcatatagatgcaaaatttttgaatattttcaagccatggttgtttgaacctgtcatgtggaaccaagggatacagagggctgactatattttaaaaaatgaaagaatattctttgaccacagcagggggctactggcatttggggatggggacaaaaatgttaaatactttgcaataagaacattaacacacagtgaaaattgtcatgtcaatgctcccttcgttgggaaagctgcaattagttataccttttctctctcctattagagaaatcaaccaagccaagcctgagtatctcagaatcagcatccttcagactcaaatttgagtcctgactactcaacatctataagcgttaagcacttactttgtcattcaatactcgtttaatctcctaaaagaacggcaagcttcttattattgcccctactagtggaaaaaataaagccagagaaagcaaagattctaacactgagcccagcacaagtctaccaccttatgctgtttctatgacgttaactttatagcatgatctggattgctaaaaatgttcaagtttgggccttataacaatagaaagaggactatataaaactacagtaagactaaaagtagctaaaacatattacaaaaataaaaaactggagtacctcgattatatacaaaagagcctttgaaaaatgtctaggtgaatttttgtctatgtacctatgttgacatcacaaaataacaactatcaattcaaaactcattccttctatatgtttttctcatatcgattttaatcaaaaggcttaacttgaatattaatctttcatgtcctccttatctatttgaccctctggaatactgctgagtaatgtggcattcacaagaatattactgtgtccacttaagtgatttaaaatgtattctcaatagccaaagtgtcctcctgactctttgaaattcagccatcctatgtttcagatggcctttcacttgggcttttaaaccactttacagacatctctttattctcctttattttataaattgggaaatagatcaaatagaagttaagtggcatatagaggtcaatggcagattactggaagacccagggaaaggtatcacccttgactcacctagagttatccctcagataatttaacatttcttcagaagactgaggtagcctctgaatgtaggaggcagactaaaagattattttttttcatgaggctgcctcaagcagattcacatttaattgtgattcaactggcatctcctttcttgctgccacaaaatatctatattgaaatcaggttgactgttcatcttttctttctgttacgtctgctagggatcaatagagataaaaatatttggagctttgtgttcaatctaagttcctgcatgcagttgcttgatagaatgattttgtaaggaagcaagtaaccaaagtatttttgcagtgtttttgataaaggactgctctttgctggtgtcctcctctccactactaattgacaaaacatcttgaggaaaacatccatatgtttaaattatccttaaaagctctattggcattaaaaaaagacctccgttttgataaagattccaataactatttggcttttgcaagtccagctttatgactagaaatttctagatcaagagtctgcaaacgatggtctagaaccaaatacaactgctgtctgtttttgtaagtaaggttttattcgaatacagtcttgcttgctcatttaaatattgtctaggctgctttcatgctacaatggcacagtggaatagctgggatagagactatatggcccgcaaagtctaaaatatttacaacttcactatttacataaaaatttgtcaacaactgttctacattaaacaatatatcagccctggcagatgtaactggttaccttgagtatctcatagcatgtatgcagtgtaattttcaagttcccaaacaaaactttccaaaagccatttcttaagaccacacactgtagagtcagatccaccaagttttgaattatctgaacagagctttgcaaatgtcaaaccagtatagtagatgatgacgattttgctgaaagatcactccactttcatcaggggaaacaagctattgggaatatattttaggacctcaattttccacacattgctctaattactagagtgctatagatgcatatctctgatttacagtccgccaagtcaagatttctgaatttcttggcataagtttggtagtacagtattactttgattatggcttcttatatctggcataaaaatattccctttgtgcatattctttttagatacagtacaaaaaaaagtatgactcttccttttttctctccctttactttaggaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataaggtaaggggaaaaatgtcaaaagtacatgaaaaaaatcatctctaagaaagagcaacaaatctgctagctcttaagaacttataattatcattgctggttaattggtattatagattacccagttctgacatgtaattttctaacacaaagaggtttctatcatgttacattgtgctttgcatttagggactttttattttacatttacacactaaagaacgaagggcagaagtcttgaaatatgcaaggatttagataatgaattgcatcctaaatttagaaaatatatcagacaatacagatgattcattgtagaatttgtaattctggaaaggcaagttttggggaccattgtttataaataagctaacttttattggctcagatctggataagtaccagaagcattaacgaacatttcttcagctgcacacggaccttcaaaaagttctaaaacagggtatgttattatgttttacaggaagatgtgtttaatatttgtaagtcaatatggataataacactgatttaaatggactgatagatgcatttgtcttttaatgtctattataataacaattgccaaaagcctatgaaaaattcaacatttacttgttgattagtctgtttttgattcatatatgcaattaattcttaagtgaagtttttcagagacactagcctctccttaaaaggcaaccatgttcacttgaaaatgtgaacagactatagatttgagattctggcttcacgctttgtcctgggaagcaaccttggatttggaatttaatggcttcctggctatctggactgtgaagaaatgcttctgaggggagacagatgtttgtctgaaactctattgtttaaagagctggactttgtctgtaacagcaggtatgaagatcagaaagaaagattgggagcccaaatgaaggcattagtactttgtaaacatagacctcatgccgcagtctgggtggattgatgataatgctacaaagaaaaatgcagcaaaggaaacttaggaatgaacctaaaagacacagtgtcttagtaaactaaaacgaaagtaaaaggagaccttcaaagcccactgcttgtaagatgagcttcttttttgaatattattccttaaaggacaccacacacacccaggtgaactcatggaatttgcattaaataattgataactttttgacatttatttgaagtttccttccaggaaaaaatggttcaagtagcactctggcattatttcataattaagcagccttttgcatgtaccatatgcaaccaccaaatctaaggtcctgtgttatgtagcctttccaacctttctaaatctcaagttttcagtaaatttaatgttttctttagagaaaaagacagtgagagacaggcagtgtccatttgaactagcaaatagtctgaccagatgacgagtctactagctcttctagtagctgctgcaaccagcaacttagtgggggcaacatcctcagccatgccacgtgggctttgcctgaagacaatagataacagccaagaggcagacaaagaaaatatgtgtaaaaacaatggtaaataaagtaaataaaattaacgaattagataaatgaataaaaataaagagcaaaagcaaatgtcaacatgcatcaattccccatccaaattacatacctcatgtaatttttgtaaacattttgtaagatttaccttcttgatttatcagcaatcattctggtttgcaataaaataatacctgtaagtggtttaattggaactgctgccactgcttgagatttatgaattggaatattacatgataatccacaggatcaccttgctttcctattgctgaagtttgcctcaattcttccttccattcattcatttactcaacaagcctccattgaaggtctgctataattcacataggggtccccctcccttaagaattgcaaattatacatgcaagagaaaatattgttttcactttttaaaaattatttcatttctatttttaaaaagagattgttttcagacagatgggctaccctgtacattttttactttgacaagtacattctgcaatgttttgtgggagaactgagtttatccttttgttaacttcaaaaggtcaggtatgtgcctcaatcctcatttgtttctattacaaacatcttaggaatccataaagttatataaactttcaaatactttgatatttgatgagcaaatctatgttcattctgttcataacctttatgacataccaaacaccaaccattttatctccaaattccacaaatgaaggggtcattatcacccaccaaaaagcggtttacaaagattttaacaatgtataaacaatcttgcttgaaactaatgaactcttacaatctttctgtctttttttaaaatttttgccattacttgttaaagaaagtgaccctattggatcgtgttttcacgtaataaattttctgcgaaatttactgtttagtccttggaggcatattactaaaaatcaaattggattttcttctgaaagaaggttacagagtgtgacttcatgagtggaagtatgttatggctaaagagcccatatttcatgctgtaatatagccaagttacattggtatatatattccttggccattgaaacaatgttaaacaatatttttcttttgtctaagatacagttagttaagctgtcattaaaaaataaacaaattgataatcagaaaaaaaaatcagagcaaagcaagctgtcaaaggttggctgtaaatccagcacaaggtaaaatgtggctattttaaaaagggcaacttcttcctaagataactgtttttttttttctctgcttaaaatagtcattgagggatattcaattgggaccagagaaaggggaagccagaatcattcatcaggcagatactttgtgtcagttataaacagtatatttcaaaattaagtatgagaaactccaggaggagattagacatgaggaaacaagctcagtaaagctaagaatcttgcctatagtcatctgtgcagtaagaatacactatgactattacagctaaaatatctttttaaatgccaggtattttctattctaattcttagaacaaattagagaactgagatttagagtggccccctcctctgcctaaaagcactccagatctggtcatttaatctctttggtatgccacttgtccccagggaaccaaactaacaagtttttcttctggtgtgctctttagcaaaaatgtagagtcatcagacattagtgtgtttgttgccagcttcgtgtgtgtgtgtgtgtgtgtgtgtgtgtgtgtgtccctctctcccctgcacttccaactgatttaactttccacttgtaggtgggtgtagctcagagaagatcaagaaatattgcactccctctactcaatattgtggaacaaattaaaacatgttcaatagttgtgtacctacaataggtaggagagctaggggctggggattcaaagatggcaaacacaatttatgctcctaagcaaatacacaagctcagcaatgggatagacaggatcaagtaagactgaatgtgctgtgctataatttgggcacagatcacatcctcttaatgcacaaagaaagaaagaactccaacaatgagaggagaatggatgggagggactgaggcaaacttcctgatgcctgtaacatttgaactgatctggaaggatgattataaaggattttaattgacaaaaacaatggtggaagagactgcatgagccagtgcaggaacattcttacattctaattatattcttatattctcatattctcacaggacattatctttaccaatgttaaatgattaaactaggtaataaacaaggcacacaatgatcaaaagaaaggggctctggggatgaacattctgcctttaatcactaatggtgtggcctaaactgtggggattaacaatgctctgtaatacccctaactatgcaatggggataagaagaacctctcctccacctgggcattctttattgttgtcttcataaagacttaggtgtatggaaaattgggcccagtgactgacatatgacaaagcacttgaaacatgattctatttttatcattattagttctaccaataataattatatacaattaatagaaataattcgcttccccaaaatcaagaagatagaattttaatataaaataaagttttaaactaaggatatttttcttcactagtagaatttttgactcagcatcagctggcaaaacgatttaggaaaattaaggaaatgttctagcatactccaaatcacatgatgtagttgcctacatattccaaaggctttcattctttgctcattggcatccatatttccacagaaaaggtttgcaagctcagggcatcatgctaatgtctaagacattccatcaccattaagggactttaaaattattcctagtgacaacaatatggttctttgtgttattaagtaaatcatggaataataagaacaggaagaacactatctcgttcactaaataaatgatcactatcattaaagagctattaaaccaaattctatcaggtatttttttaaagatgtgttcattctttctactcacttgctaaataagaaagaagaaaagctcaagagtctttaagcagaagctctgttctgcagctcacagaatggattaacaccagctggaaaaatctggggaaagtaggctaatccttgctaagttggtggccctatctagctgctgcagaagctgcagcatctgggactggcttttactcccaactggcttcacccttcccctataactcttatcctaatgttattcaaagagaattccatcatttgccctgatataagcatcaggcacacaaagtcaacccacagacactcctgcctatccctagaaattttgaaagctccagtatctgtttagcactagtaaatcatttcctgcttggtcaatccatattttactttgcgtatacagcctctacttttatccagttatatttaattaataaaaataattcctgtcttccaactataccaaggaaaatttcttcatcacaccattttagaacatttatttacaacatacggaaatacaattatatctttaagttaacaacttgtaactgagataagaaggcattgcttctctgagtttattttgttagagctgttcttttttttttttaaaggaagcttctgctcagaaaatgtgaaagaaataatctatctcaagaccttgctgttcttgactgttcaaaaattctttaaataaaatataatatggaagctgtgctctgcatgtcgagaccatttcactgttgagccttcacagccagaaaacaggctcaaaataattagacttgaacaaaatcacattatttactttttgctttaataaggaggtgattattagaagatgaaccatgactaccaagatagcaggtatagattctttttaacaaaattaatttagattatattcactatcttaagatacttatgcacataaatcatatctctctacgtatttttgcatgaaacatagagtatatgaaataaaatgaatgcaatgaatagaaatttaatcatatatttacctgaattattagattattcataaatagcttattagaggcagtaaaagtcgacagagaatgattgcaataggcagatgtgatgtaagtctgtgatattttagaagaaattttcctgtaaatcacacatgaaagatgcagccactcatgctggacaactgcctggtgttcccaagaaacatagggacaaccaaagggcacctcagtaagtttatactggaccatagataataaactcatcaacaaacaccagatttttgttctggagaaaaagatgaaagcttttgaacagtactagtcatcaccaaggaaactgtggtggagtaaaaaaattttaagaagatatcaacattgcagtaaatcaacctaacctggaaatgtgtttggtgacaaactgaattttcctaggtgtcggcaaactaactcttttaaggccccactaggggccttaagtgatctactccccaattcttccatagatgcacaaaaatactaactgatctattcattgtgtgtctttagaaatgcagacatttaatgggttacgaagcttaactgctagacacattcattagatgtgaacagttaatatgtagtcatttctgttggcttctaaaatatcctcatcactcttttgagacatagcagctcatcctaggccaatgatatcaaccatggctgtactgtgaactgtaatccagtatctttctctcaacacctcctctcttctcagctaagggtgttgtatattgaagatgctctgcttttccctctgactttcatcacttaaaactttgttgatttcacctgaggcaaattgacaaatatttttaatcatctttcacctttctttctcacttccaactcttctccaattgcctgactgaaatttctattccttttcctgtttttttcctacatatttcagaaatggccctgatttgagcagaaaatattaagaataatgctaataaaaacacattcatgttttcaaatgtaattaaattttaaaaaagttttatgctcaaacatttctagaaatatcctaaattacatttcagaagttttataaactatctcagctatttcttttcctcttgaagtgaatattttatcatcatacatattcaaaataaataaaatactatgttattcaattattatgttaccatactactgctgttttagttcattcagctataacaaaatatgacagactgggtggcttataaagaacagaaatttgttttacacagttctggaggctgggaaggtcaaggtcaaggcactggcagatttggtgtctggtgagggtccactttctggatcatatatagtgccttctccttgtgtcctcacatggtcaaaggggtgaggggtctctcttgagcaggttttataagagcactaatctcattcctgagggctctgaccccatgacctaattatctcccaaagtaaccaccttttaataccatccccttgagggttaggattttaacatatgaatttggtgaggacacaaacattcagaccatagcaattgcctttttctcataacatataaactctcaaactatattatatggtaattagactttagaaattagttttaaaaatctaactacaatgttcaaacaacgaattcactaggaaacttttagaaaataactgatttctaagttggagacatactatgtaactgtattaagtcacaaagctcaaattcagtttttctatttgacttcagtgtcaagattcttcacattttgctaggctacttactctccatgttcaagttatctctaatgactatatcgaaatagaacacagatgaaagcaaaaatagaaacacagatgaaagcaaaaatagaaattgaaccacaaacatgaaacaggtaacaaacagaaaatgtctctgagaaatgccttataattctaaaataaatttggaactagatttttgcagaatactgcttaagaaattaaattgtaaaacataagggaatcatttgaataagccattaataagattaatggaaaataatttattctcattttatctctagatgccatgtccagccaaataaatgagactgaacttcatggttgttgtttttacttcatcccggcaaaagaaatgaaattaaatataaaaagcagatgaccaaataaagtccaaatgaattaagtattgctcctagtataactcacagttaatataagttgactatcctctctgtagacaacacttttcatcaacatttttcaccatacagctagacctcaactaacagtcaagtgtcaaaaaaatgaatcactttagaaaccatcttaataatgagacaattgacttctggtacccaatttagaacatctacaaaaggagtggtgagcagatttccactctgatgcaaaatcttattcgttgggcattgatagctgagtgctgtgttaaggattctgaagtggtaaatcacaaagaatgctgtcaacacacttagtaaatagttaacacaggacttctctagtattaaaattcataatagtggccaggcgcagtggctcacacctgtaatcccagcactttgggaggccaaggtgggcagatcatgaggtcaggagatcgagaccatcctgactaacatggtaaaaccctgtctctactagtctctactaaaaatacaaaaaattagccaggcgtggtggcggacgcctgtaatcccagttactcaggaggctgaggcagaagaatggcatgaacctgggaggcagagcttgcagtgagccgagatcgccccactgcactccagcctgggtgacagagcgagactctgtctcaaaaaaaaaaaaaaaaaaatcataatagcaaataaatggcattcacgttataccatctccttttttgctcatggcaagtagtgtaatccctgccagaacatgggaggagacaatgtaacacatgtgccattcatttactcagaggtatacagtgtctttccttatgtgttaccaagtttaggctgtctgcacccctctgtgcactgttttttggagactgttccaatgtcactaggtaagatgctaccccctgtgatatagcaagacatattttgtgcctagagttacaaggaaaatcttttttttttctatagaaacaagactaggcatgacaagtatatgtagttttatttgttcaacaaatattgagataatacactatggttagtactgatgtatatactaaccacagtgtattatctcaaaattagatatgtatacaaagttgacccttgaacaatgcgaaggttagggaggctgacctacagtacagtcaaaatctgtgtataatttttgactcccccaaaacttaactgctaatagcctactgttccttggaagccttgctaataacataaacagtcaattaacacatattttgcatgttatatgtattatatactacactattacattaaagtaagctagaggaaaaaatattaaaatcacaagacaatatatactcactatttataaagtggaagtagagcatcataaaggtctttattcttatcaccctcacaccgagtaggctgaggaggtgggaggaagaggaggaattggtcttgctgtctcagggatggcagaggcagaaaaaaatctgcatagaagcggaccccctttgtccaagcccttgttgttaaagggtcacctgtacgtctaattttaccatagtctttttgatgatttcaggtttaatattgaaactttggctaaaattcacccatgggaaaaatagaaagtaccatggatttttatataaaaggagtcctggctatactatttacaaagcatgctaacatatcacttttcttctctgagtcttcacgttttctgaatatcaaaggtttcaaacttcagagagctgtatgggacaaatcaaataagacattaaaaacgcgttctggagagtaaaaatgctagcagatacaggtgtctcaacttacttgttaccttccatttctgtcccctactcacattgctttcttttctgtaattgtgtttaaagctgtccaaagagactctccaaatgctgggctctctgtctggaagtttcaaatgaggcttttggatgtgcatctttttctctgagggtaggattggggcaagaaagaaggtgatttaagtgtactggttgcctgggtgacaattaactgggtattgcttttagggagtcatacagaaaaatagaaaagaccagtaaaaaatgccatcctagtttgaatgctggatgtagtgaagggggttttgatgaagaaactgttgaggatcaactgagattagaaccacttggagaattaaaattttaataaggaggcattactttaaagtgaggggagggatttatcctaactgatgccttgttaaaaagaataacacagagtaaatagtcctaagaacaattgcaatcctttgtagtctgtaatttgtaattgctgcacataatttcagttaacaggccataagaggaacagtcacaaataccaagaaaggtacatacggagataattccaaccaaggtgagcacagcctacacataaacaggatgtaagtaccgcaagtcaccaaaactacactcaggagaaagtgctcgttattaacagacagtggattagtttcaatatctacaccaggggtcatcaaataggcccacagggtggtcctggatttgcaaacacagctttttgttgttgttgttgttgagatggagtttggctttggcttttgttgccctgttgtccaggctggagtgtaatggcccgatcttggctcaccacaacctctgcttcccaggttcaagcgattctcctgcctcagccacctgagtagctgggattacaggtgtgcaccaccctgccaggctaattttgtatttttagtagagacggggattctccctgttggtcaggctggtctcaaacacccaacctcaggcgatccacccacctcagccacccaaagtgctgggattacaggtgtgagccaccacacccggccgcaagtagagttttactggaacacggccatgtctcctcatttgctattgtccagttgctgcttccacactaccaggacagggctcagaagttgtgatagagattgtgtggctggaaaagcctaaaatattcaatgttctggccctttgaagaaagttaactgaatcaatctagactgttacacttacagtgaaaataattaaggattaggagttggaaggataactcaataattccattcatttgtgatgtgtattgtcattatttcattcaatcagcaaataactgtgataacatgtgcaaggaaacatgggagatgcaaaagtttagtaaagcaggtatcctgctatagtggagagagctcaggactatgcagacctgggcttgaaacccaacttgaatggattaagtggctttgaaggagttacttggactctccttaaacctcagttttcttgatcatttcacatcatcatttcataatcacgatcattttctatgggcatatctattcaaaatctctctatcagatcccccagtcaatatggagattgtggtaggcaccaagacaggaaggtgtgatttaggatcaactggatttataattttaaaagaatttatttatatgactgatgttttgtctggtggagcctgaagtaactatgcaaaatatctttgtattattactgcttgtttatgttacttatatagttatattatttcccaatcaatttcatcttttgtatttttctcttcaaaagttttgggctttacaatctcaaaacacattttcatcattcacatatttaaaaagtgacttttttcagagttttgttattgaagcagtgatacaaaactggttgactttttttctggggcagaggagagagtcaccaagtcaattgaattaatcatttacctcaccaccatatataccagacacagataagacaaactgacttttataaaatccctgcaaacccatcattacaaacattaactgggtcaatttcacctgaaggcaggattactctttcctataccaattttggatttcccagattaacccgttttttgttttgttttgttttttttaagaagtgtggcattagcaacatattcaaaagtctaaatgcttataagctgctttgaaaaacacattcaaaagtagaaacaaggttttagggaagcaaagataggaaacatgaatgagggtttagtaaacatagcataagacacttgttatcgaggcaaaaggattaattgagcagtaacatcatcagctatggttggacagaggagtggagataccagaagtgctatatccctgcacaaataaggaatctattttcagtttagactccaagcaggaagatactgctgctgcctcttgaagtacttcgttctttttctctgaagcttgaaaagtcactttacccaggagtggtgaatctggggtgctgtttctgtacctcttcacgcaacttgattggcatataaagatattgctataggtctctgggtacttcagtttctattgcctaaaatatgcttccaaaattagaaaatatgagcttaactctcgtaacagctgaagaagagcttacaaccttagaagacatagctctgtaattctgaaataactcaaaaactattttaaaatttcttcttctccagtcttccttcttccaacacataacattttcccaagggaaggcttgtaaaagcttctcaacagagaaaactcttaggaaagaaatggaaaattatagccatatcaatgaaacctaaaaatcaggcaaaatacataaaagggaaagagatgttattcctccagatttatacattcacatcttaactgatgaaagcttctctgatagaagtctgccctgaccccctgacatgacataacctccacagtcatttttttcacaatcatttcttatattctcctgctttattgtcttcatagcactctgtcactatctgaaatagttgttctgcttgcaccgttactgacaattcctcatcccccatttcaatgtagacactgaaatcagagcctcttctccatttagcttagtgtctagcacatactacacattgaataacatgtggtgaatgaatgaatgaatgagatgttccatggcagagttcatctcccacctctggttgatattcagtcccagcaaggatgtgcagctatcaagaagtaagcacacactccaatcttacatctttggggcattcttcttcggactgttgcaaaaaatttccttgtaatgtatacagagagcaactgaaaactctgaaactctaacgcattagacaaatatagatcttttaatgaatacttttatttaataaccagaatagcccttaggtattgtctaattcacagccctttatatagcaatggagaaattaaaattaaatggcttttttttccaaggtcacaagctagtcttagcttgagccagtatgaaatgccacgtctctgaactcctagcctggtgctcattttactggagccaagaagataccttcattgctgggcaaaggaatgaacaatgattgagtacctaacacgtttctaggcactttgttaactggttgtggtagacaatgtgtgttgctgacccaagcaccatttcttcttcctttcttccttacagaatcccaaatttttaaagtaagcatcccatcagtagctctagagtcagattctgtctagtctaagtcatttcatgcttagcaggtcccattacaacagccactggtccaggggtggccacgtaatttaatttggttcaatcgaattgaaggaaaagaaatgagccatgcctggaggacatgattctcttcccaccttcccctttcctctgctagttataaacagggcgatctacagcccaatggctgcctgtagccatcttgtggccataaagagattcatctttaggatgaaatcactgctgaagatagtaatgtctatatttatattaagggtcagtaaactctgcaaagaatcatatagtaaatattttagcattgccaatctgatggtccttggttcctgcagcaactattcgactcagacattatagtgcaaaagtcaccagaatgacatggctatggttcagtaatatcttgttttcaaaaaaaaaagtcatcgggctgtttaaatcattgaacctttttgacatcattgagccacatatttcatcattccttgagcttatcctgcacattaactcccaatatttgagatgatcaatttccttatgatttaaactggctttagtaagataatttttaaatgttattactaaaaccaaatcaatataattaattcagcatttatatacattattactcataatattcacaaaactcccataaagctgatattagtagactcattcttaagataagaaaatagaaccaaagtttcagagtctttgaaaatactggttcaaaaaccggcatttgaacctatatgtctaatcttctactctatgatgacccaactcccaactatctattcctcagcacttaaaagtggaagaacagtagctgcttcagtaaagttccaaacccaccaccagcttatcaaacagaaaatgatttcatgcagggaagtgtgcacttagaaagtcttttgaagggctggaggaatggatgtcagtggactgcccctgaatttttagtttctaggtcataccattatatgtgaaatccaaaagtcaggcagtggctactgctatcagttcctaccactgtagccaccatagcctcctcacaccaatggctccccagaatgtcatgttgaaccactataaacttcataactgtcaaattttacccgtagctacagctgcataaaaatggcctctgcctcacttctgatttccaaatctcttacaagtgcatgtaaatgactctagctgcaaaggagtttgggaagtatactttttaacctctccaataggaggatcaaatggagattggtaagacttctcttcagaagattgactaaggcttctccctagaatgtctggcatgtgtatctcccatacctgacaaagaatgagggcttcaagacagctaaaaaattttgaacaagctttaaaggactattttctcatccccagtcccatcagctgagccagaataatgacttcatagtaatttttccctgtacctttgagggaaagtaatgcattcattattggaataaaagtggttcatgtgtataaatcttgcccttggcaaaataaattatcaaagctcatgccaatgggagagatggcaggtccatgatgctaagagccaagttccataaagtgatagggaagcagctttcttttatccaaaagaatttatgttttatggctcagtgttggtgaggtattgatcttccaaatgagacactgtggccactgtaaataaattcaatagatgtgtagttggcctaagaatataacctcagttatttaaaacatgtggcacttgatgcagatcaccttccagtgtcctgtgtggaagaatggagcttccacccagtacaaagagtactctgggactccatgcctaagctccttaattagcatagtacatgtttgggggtaaataactccacctctctcaatcttaatttccacagccctgaaatttggacatgatagtatgggaggattcatgagaaaatgtgtgtggaatgatttgaacttcttgaagaatacatactcaggaatactgctatttgtgatgagatagtgtcagatgcataaatttgggttctttgaattactggcatacaggaaaatagcaaatctaggtcaacagagacctttttctcagactgcctttactatgaataaaacacaaaggaacttttctaactttctcagaaaagtgtcaacttctataattatttcaataaataatcttcctccaggaggatataattttaaggtgtgtgcagtgtccttttaaagacaggtttgtaggtctcactttcttttatttccaagttatcccctggcaacaagggctgtttatgtggagtattaaacaagcttcaggactgtgcacagaactcactcctattatatcttattttaatctgatattaccaaacttcccatgaactaaaaaaaaaaaaacccataaattttaagtccagtgagatttctgttttctctggaaattagagagctgaactgtgttttgtgtgagatcatccaacagtttttttaaaaaatcttacttcagaatcacattgaaatcattatgtcttctggaaaccagctgatagccaaaacatttatttaaattgtttataaaatgggtgggtggtatttcataatagttattggtttactatgcatgacctgttgatctacctgttgaaaccattattttaaaatatatttcccccaaaaatgctacttctgtatatttgtttttatcaaatataaatttacctagctcttttaagacacagatctcacccactgaattatgactaacatgaattttggaaattgtcctattttgatatgtcaggagagaacgttttactagcaggtttcattagccaaggtggaccagtgggtattttctgacattgcaaaagcagcttcaaagtgccactttcctttcctttccaggatgggtcaaataaaacaactctactccattctgtaagagattcaggcacagaaaggagaagatactgggctgctgacacattttctattcataaatgcttctgtttatagtagaaaatatgacattcaccatgagctgaccagccatcagttctgacatttatcagcgtcactttagaaacccatgtgggaaggcagaaaagcagaagggaacagaaactcacatgccacttgtagcagaatgcttgtgccatcctgactccccctctctgaaagcctgactgtgcaccatcctccttgataacaactaccaaccactgagcaagcctgcggtaggttatgtaggttctaggggaaggggatacaaagctatgttggacacttggaaatgcttagaatccagtcggggagccagcacaggaaacagaaacatctgaatgcatagccagctactggccctctacatgtatagccagctaataatgtgtgtgtgtgtgcatgcacacacacatgactagaagaggcattgtgcctggcagtgaaatgacagaggaaaggcatttattgtatgagggaaataaaagtagggaagtggtatcttaagagcaaaacatacagtctattccttccactccaaataattgaatgcttctgaatgtgcattccaaattttgagattaaatgaataaggccaacctgctgctgatggccacagtcagaaaggagggaagagaccacccaacccaggacaggaagtggagcagacttcatctggaacttgggaatgcctgcctccatgaaaaaaagtgtaagtgagatttccccctttttgatccatcttcaaccacttgataaattttcacaaaatcagtaatttcccaatgtggttgtgatggagcagggtagcttcctatttgcaagcattgggttaagcatctatgttttaaaagaattaaacatattaatataatactgtcccaatagtgcttacaaaacgtgtgtgggagacacactgctgagtttcaggaaataaacatcccttaacacaacacattgtaatcaaagaagcatattcacaaaacgttaaaactttttgccaacttcatgccagcaagcccagagggagagaacacgtatgctctttttcaatagagtatcacattatagacccattcaataaggtctgtatgagttcatttgtttccagataaagatttctgtgtgtggggagacttaacaacaaccacaaaaaaaggcttcgtggagaagggaacaaattagttggtgttttaaaagacagaagtatgtagacagtgaaagaggaatttgcaggaaatgtggtgggaagggtaccagtaaatcttaaactgagggaagagctcaggcgaaacctccagtgatcttcacaattctcaggagaatgcttatacatgatttgcacacaaaatattgaatttgaaaaaatcttatattgaattcccaagccacttgtagaatgcaatgtggcacactaatgtggtagaagggacataaaacaaacaaacaaactccctgcacaaatacccatgggaaaggaagaacagcctcacagaacttcaaaaagagaaaacaaagaaaaaaaatctcattttccaatgtatgcaaacatttattttctgagcaaagacaggattacaagtaggcagaatataagatttgaaaagcaaaaggaaaggttacatctccccaccacctaccacccacaaaccagttcatccacaggcaagctgatactgagactctacaactacatatttatacttttgacttaaatgtggccttctcttgaacagcaaataatcccaagatttacaaattaagccacatgaggcatttacacattaaagaaatgaatttttaagtctttcttaagacagagatttttgggtttggaagacagagaaagaatgagagtacttaggggaagatggcatgggttaggggtgacatttaggatgaagtgaagagacaagttatagtagcttaattcatagattaaaaggaagacctttataggaatctggttgtatagctaggagccaaacagccccttcctgatcaaaaatgttttcatctagtcttttacaatagaaatttgtttatcttgttttaaagtattctttatgtcatgcatgtaaataccaataaggtatttaaatattcccatattgacaagtatcgctttgcttctaatcttttttttttttttttttttttttgagatagggtctcactatattgcccaggctggtctcgaacttctgggctcaagctatcctcccactccacttcaccatcctgagtagctaggattataggcacaagccacctcacctggatttgcttccaatcattttctataagcaaaatgttacatgaaaatacttgtatttatatctttgtaattttgtgcaagaatttctaaaagaaaaaatcttagaaatcctagaaaaatcccaagtcaaaaggcacttgtatatataattttgaaaggtcttgtcatattgctctccatagaagatacaccaatgcatcttcccacctgcaatgtatagaacacctgtgtccccatattcttttttctttttttttttgagacgaagtcttgttcttgtcacccaggctagagtgcagtggcacgatcttggctcactacaacctccacctcccaggcagagaatcaagagaatcaagtgattgtcctgcctcagcctccccagtagctggattacaggcacctgccaccacgcccggccaattttcgtatttttagtagacacggggtttcaccatgttggtcaggctggtctcaaactcctgacctcaggtgatccgcctgcctcagctccaaaagtgctgggatttcaggcatgagccactgcacctgacctgtgtccccatattcttgccaacatagtgtattatcaaacttgttgatctttgccaatctgaaaagcaaaagtagtattcccttacagtttcaactgctttttacttgacttacagtttatctgggtagaaaatttagggatcacattctttacaggttgtggttattgcttcaaaagactctagcattttatattaatgtagagctaataaggatgacctgatttttcttcccctagaagggtctttaaccttttgcctgcttgaggagtcctttattatatttcaagtccagtagtgttaacagaatatgtcctttaaatatatagacttagatctccttttataaataagtcctcttgaattatattttcaaatacatttgaatcatccaccacttttctaaactctacaagctcatatttctttccgtagtcttctcatatctttcctgaactcttacatgaattttttgtgcttttattttatgaaagcagttgctttaagtcttattttaatttcattgatacatttaggaacaacttttattgttctgtgaaaaacgggtttgttttccagagattattctgtaactgccatttggtttttatgttctctttaaaaatgacaatacatactatgctagtttttgttgtttttaagaatatacctttttcatttgactaaaaatccttgaccagctctttccagaaaatgtggcaggggaacagagacatgttcaagtctaaaaagacagaattatatatgttatttcaattttacttcgccccagtctaccaaaatcaattctgcagagctgctcacaatgtgaaatttccttatgtcctctacctcactgatactctacctgcaaatgcagctcatctgtgaacatggcccataaagatttccctctctatttctcctcagaatcagactcagggaatttcccactaagagtccctagaccttggtcctgttgtaaagaaaaacgtgccgttttgcaataggttgtgccacttaagttagaaaggaatgctttgccaacattttctgagctctgaagttatgaccatttttttccagtgtctctctccactcacacctgtttcaccttgactgatttggggtgctcgcttcttattttgcaattcagagatttaagtagtctgctggtttcaaccaaaaatttaacttttttgctttttatttttctggttagtttttaataataattgaaagaaaaaaataagaaatggtcattttaatcagccaccataaaactaaattttttaatgtttctttaagggaatattttaactatattttgtttcttgtattgtaattggtctatttaggttatctacttttcttgagtcaatgttagtaatttacagttttctagaaactatgcatttcatctggattctagatttttttaaaatgtatatgctattttacatatatttcgttacatgtataatgattacatatatgataaaaatgatatatgttattctttttatttttaaaaagttctctttatttgtaattatatccccttatcttctttcttcaactaacttacaaagtagattggtacagattaccagatacttttcaatgttgtttaattcataattttttctttgcaaattctgatttacttgcattttacttattattttccttgatttagagtacaatactttatattaaactatgttgttttcaattaagcattttggggattgtgaaattaactctgaatattgcttttattgtatctcggagggattgatggttaatattctcactgtttgtttttaaaaagtttctaacaccaattttgattctctgtttattgtcactgttatgcattttttaatttctatggtaaatggatttaattggctattaattcattgttcttttctaaatttacgcatgtagtttaatgatatagtctgaattatatccatttggtattttgtttttaatttcttgagatgatgattaatgactaatgtctagtaaattatttcagatatttcattaatgttaaaaataatgtatattcttagcttaagtaacatatttctatgtttagtaaatatatgttgttcatcatgttttaaaaatttcctgtattcttagtttccaagaaaaaagcattaaagtgccatagaatattaaagagcaattaaaagaatgaagatctcttcatatgctggtaagaaaagtcttccatatgtttagtgttaaactaagtttggaacatctacaagtctttgcccaaatactctcagtgaagcttgcctggccatcttatttaaaattgcggcactcctcaccacacacacaaacttctcacccctcttcctctgctgtgcaatttcaccgcattgccatcttctaagatgttacatgatttgatatgtgatgcttattgctcatcatctgcttttctccactggaatggaaacttcacaagcccagtagtttttgcttcctttggtgaccaatgtgtcttggtgcctgtacatgtgggtgctcagtagttacaggttgaaaatattagtacgtgcattacggtaattcatgtaaaaacaaaaccacaagctactttggaaacaagtatatgcaaatgtatagaaaaagatctggcagtacactcaccaaattattaacagtgtttgatttgaaggtgtgactgaaaaatcaagacagctattaccttttatcagatatctttccattacctgctaaatttcatacttaaagagtattgtctttgtcattgcaatgttaaaatttttatttggaataataaaccattcagaaaacaattaaatattttgataacaaagagtaatagatgaggactatccttgacatacatgaaaatacactataagattccaatcattcaattagaatggtattgataagagaacagacctacaaatcatggaactaaacagatatctgatatagattacttagcatatgtaagaaagtaccacataacaaaagagacctttcaaatcagtgacaaatagaaggatataggaataactattagcttttggaaagacagggtaaaacaatgtaaattttcactttatatataaaaatatgagtagatttgtgaacatgaaacatagcactcagcacagaaaacatcataaataaaatttaaagtccaatattgtcttagaaaaaattttgaacaaacataaagacattaggttgagatccttattaaatcaaggtcactaatgaaaaacactaaaactctagtaaatagaccaagctcttaagtatgtagaactgattcaactataaaccaccagtttgtttctctgatttaatgggacaaaaggcacttgcagatggttactttatacagagtgactctatgaacaaagtctgtggaatccacaaacagcacacttgcagaattttgaaaaagctttgagattgtgggagtactgccctttacataaactgagacttcccacatttatttttattgtagtttaaacacaattcaaggatgctagttcaatgacaaatctgcacgaagtaaactgggacaagaggttattcaattgcccagaacaggaagaatttgtctctctatcatccctgtcaataataattagccctttctgaaaagggtgttgtagatacacagtcaaaatgatccttaaagggaggatataatttggcttacagaaatccattaccaacaaataactgcttgtggaggaaatatacaacaaagcaccacacttggaagtgataatcacagtaaatagcatccctagcctagattgggtcttatataagaaactatcatattgccaattaacaagtattttctcagtgtgatgacactttgaaatggctaaatacaaaattgggaggagaaaagaaattgcttagtctcctccctacccctcatcccctgcctccacagctccccaaactacacaagagaaaactcaataattctgtaagaatgattttcctggctcagttttataagagacttagaaataatacaacatcagtttataaaccagacagggcttggcctgctatgtcaacatagaaaatcaatccaggagtcccaaccctgctttgtggcctttagggctgcttcagaaatcaattcccaagaaggataaaaggtcactgccatggggctcaggaacacatgcctcaaattgccagctgcagagctcaattcccccagggacttggcaatttcggctctaaatgtggattcacaagggagagccatcctgaccaagcacatatgctcttttgaggtagtggccattttcatgccgacatttttgaggccctatcatgggtcaggactgagctgaggctttccatgcattgcctcactgaatctccacaataactcctgtatgagtccgttttcgcactgctgtaaagaactgcccaaaaccgggtaatttataaaggaaagaggtttaattgactcacagttttgcacagctggagaggcttcaggaaacttacaatcatggcggaaggcgaagaggaagcaaagactttcttcccatggtggaagaaaagagacagcgtgtatgtcagtgcaggaaaaactaccatttataaaactatcagatctcatgagaatttgctcactatcacaagaacacatggggaaaccatatctataacccaatcacttcccaccaggtctctctctaaacatctggggattacaattcaagaggagatgtgggtgttgacacaaaccctaaccatatcagctcttgagtagatgctatcattatcatcatcccccttcacagaagggcacagagggacttagagcatgtggctggccaaggtactaatctacccagtgaagtcagaccttttaacctttttctggtatgtttgtattcattcactggggctgccttaacaaagtaccaccgattgggtggcttattcaacagaaatttattttctcacatttttagaggctagaagtccaagatcaaggtggcgtcttctgagacttctctatctggcttgtttttttcctttgtcttcatatgatcttccctctgtacctgtctgcttcctaatctcttcttacaaggacaccagtcctattggattagggcccactttaatgacctcatttaaccttaattgcttccataaaggtcctacatccaaatgcagtcacgttctatagtattgagggttatcactttaacatatgagttggggggagcacaactcagtccatcacattctctattattgtaattgttcagatccatttatctcttataaaccaatgatcaaaacctgtacatccaactctctgcccatcccataagaaatacctggttgtggctggagaaagagctacaatatactggctggtctcacttggcatgttcttgacattcaggataggcggagtgacccagcaatcatatagacaccatccattccagtgacactcaaacttcagcgtgcatcagaatccctgcaaggcttgctaagacacagactgctgcgcctacctcagagttcctgattcatcaagctggaagtaaggcctgagatttttgcattactaacaagtcttcaggtgataccaatgctgctgatctggagactgcctttgagagccactattctatctctttcccaatcaactgtcctttctcacctcccttttaaatctccagcacctgctccctcatgttcattctcaatgcacaatctttttttctccttcactgacagaggtgaaacaattaaaagagaatttccccagtctctcactactgcacctgctcaccctcccacaagcacgtgtactcactgtgcttttcttgctgttttgaaaggtgaattgtctgtggtctttctagagccaatctcttcacatgtgcaccagattccaagccctgcggcccactcaagggcatccctgcatgtcttctcccatctcttaccttgtcaactctttccactttttgagtcatcctcctcagcacaaaagattgttactcatttatcttaaaaagcaaaaaaactaagccaacaaaaacaagaaaaaacagaaataaaaccttttactggaccctctctccctaccaggtatgactccatttctctttgcctttgcagaaaaacatttagaaagggggtctgtattaattctatccagttcctctcctctcattctctcacagacccactgaaatcaggtcttaactctcaacaaaattgctcttactgaggtctcagataaacttcaggttgctaaatctcatggctcacatttggtcctctcacattttacgccccttgacagagatgacaccactccttgatactttttttttttttttttttttttggcttgtaaggctttctaattcactggttgctagtctcagaactttgtgaatgatttatctttgcttatacctcttagtcctggactgacttgccccagattgtagtttctttttttatccactctccttcctttggggatctcatccagtctccctctgtatgccctttgttgccaaatttacatctccagccctggatgctcctttgcctcagactccaaaactatattcaaagtctctcatttagatcattcaaacttttcaagagtgactcctgatcttctcccaaatatctgagctgctcaaagctttccatctcagtagatgaaaaattcacccctctagtgcttaggtcaaaaatctttgagtcacccttgtttcctctctttattactccccccactgcacatccgattcaccaggaagtcttcctgtgtttaccctaaacataattcagagaccaattactcctcaccgcctccatggctatcactttcgtcagacttgctacattttagcaatcgtcttataactgttttcctattcccacccttgcctccttccattctattgcccacaaagaaacataagtgatccttttgaaacataagtcagatcacggcatttctttcccaaaaagaaatgcaagtgtctaaattcttcgcctacctcagggtaaaagtccaagttcttatatggcctttaaagacctctgtgtactctcctcctccctccattagttctctgatcttcccttcttcttttcttcctcatcctactctgctccagccacgcagtctttctggctatttcttgaacatagtaaacatgatccctcctctgagctttgagttgtttcctttgcctgggaaattccatctggagacttccgggcttgctcacctatataggcaagtctgtacatgagacctgctctgaccactcaatttaaaatggcagcaaaatccttcctggcaccccacctttaaaatggcaacaaaagccttcctggcacctttcctttctagctttggacctattacataatctatgtatcttttgtgttatcatctgccttccccgccagtatgtaaactccacaaaggttgagatttttgtttggttcactgatgtatcccaaggacacagttcagtatctaacttgcagtggaaactcaccaagtatttatcaaattatttgataaatgaatgtgatgataaatgaatgtgactgtaaaatgatactttatagtcactggagaaatcagtctctgacatccccaggaacaaaatcaacattctttggaatagtcattgataaagggttcataactttttgtgccatggacttctttggcagtctgtagaagcctatgaaccccttcacagattagtatttttaaatgtacaaaataaaatcaataaactacaaatgtagtaaattattttatcagaacatttttaaaattataaaacaaatttgtagctaatagtaatacacatacttcgttatccattaattgacaacatctggtagtggttctaataacgaccataattttgaagtactgatgtctagactgatatttcaagatgtctgtaataactctaacgtgatacgaatgtatctgtaatttccactgtgaataaagtcactggtactgccaatagcaccatggtttcttgcctatattcataaatgaaggaaatgttaaattttagctagttaaaaaaaaaaaatgaaaatgaggttgtattttctacagatacttaaatgaatgctttggaaacacttgtaaggagtagaaataaaagcagaaagactttcccctttcttactcccccagaaggtgctactgaattgttgcagataaggaaattgtaagataattgaaaaaatgataaaaatctggaagaattctgtgccaagactgtttttgctttcgcaagtgtctaaattcttgttctactttaatagaatcaaatctgcaaattatcagagtgatgatgtacatggttcatataaagcagacaatgtggaactccaagtatctgaacaatcagatcaaaatacccagactacatatcaagaaagcaggctgagtgtgatggttcatgcctgttatcccagcactttgggaggctgaggcaggaggattgcttaggaactcaagaccggcccaggcaacatagcaagacccttctctacaataagaaagaaaagaaaaaaaatagaaaagaaaagaaaaaaacagaaaaagaaagagctgggcatggtgtcacttgcctgtaatcctagctactagggaggctgaggcaggaggatcccttgaccgcaggagtttgaggttgttgtgagctatgattgtgccagtacgcttcaatccaggcaacagagcgagaccctatcttttaaaaaaataaaatagaaagcagtgcctccatgtgcttcaatgtgcatttatgtatttaagataaaataaactttttatgatgtatatttataatttcctatcatttttcactcacagttttgtggttttctctttcttttcttttctttccctttcttttccttccctttatttttcttcttccttttttttttattcaccaactacccaccttccctaattcgtaggttagaaggatttctctacagttctttctcttttttccaatctcttctggatgtttctttgtctcaaactacatagacattgtggaaatcagtatcttcatttcaagtctaggtgggtcaaatttgattctcttgtattttcactcttaaaatagcatcttgaactttcacctgtgatccatctataaggatcaaatgtaaggacttcaagagggcatctgcccaataatttctgtatacccagtacagcaaacagggtggtattgttgatgtgtactcagtgcatacaatagtatagtagtgttgtatatgctttgcagagagtagcattattgttgtatcagcacataggacaggacagttttattgcaacataaccaaaacataggttaaatgttaatgttgttgtacacccagtgcatagaacaacataaaattgttgttatatgttcaatgcaaaccacagagtagaatgctcaatttttgttgaatgacataaatgaattaaatggacacagcatcacctacatgcctcacctacaaaggcctaacttgtaatgggattactattgttgttttaataaattaagcaacgaatacagtttcaaaaagtacttagctttatttttcaacacagtaaatatgaatataacccatatcagtaaaagttgtttggggtcttcaatgatatcttaagactataaagaggtcctgacaccaaaagagggagaagcaccgcaatcttgcatgctcctggctcctgagaggttattgcagtctgccatactattgtatttccagtacttacatggtgttttggcaaaacctgagcatgtgttgtcaagtggctgatgaggatgtgattctgagaaaggcaccacgagataaaagatatgaatctcagctgggcgcggtggcccacacctataatcccaacacttcaggaggctgaggcgggcagatcatgaggtcaggagatcgagaccatcctggctaacacagtgaaaccccgtctctactaaaaatacaaaaaaaaaaatagctgggcatggtgacaggcacctgtactcccagctactggggaggctgaggcaggagaattgcttgaacccaggaggcagaggttgcagtgagccaagatcatgccactgcactccagactgggtgacagagtgagactccaactcaaaaaaaaaagaaagacacgaatctctttaacgtgagtaaggtttagatttttatcctcgtagaagaaacagcaacgcagagaatagacaaatctaccaaggtctcaattcctacaagttcccccagctgctgagtgtgaagccccacgaggttctttgaaaagtgttcctttgccagtctaaactgttctgggacttcattatagcaacgcctgctcaccacaggcaaggaaccagcaatctgatgaaggatttattgaaaatgtgggtaaatcagagtttttgttcccatgtgaatgattcccccggcaggcttgagctttagaagctctataaatacttactaagtaattaattgattgactaaagaaataaatgaaaaaaataacaataattataaatcgaggaaatgtaaaatatgtattattgtcacaatggatgaaaatatcccaaaagagatcatttggttgtgagttaggttttaaagtatacgcaatattagaaatgaataattgaagatagtttcaataattttaaaaactactgcccaatggtaaaagatataaaagattatgtaatttacaaggcagatgtcctatatctcttgaattattttagactgggacacaaaaagcccaggcagtcaagatgatattaaatgattcaaaaatagcattatttcaattaaacaaataaatgcccacaagacctacacaacaagctgaaaaagttaggtgcttatcacatcaggattctgtactaccttcctttaggaaaaaaatattattgaaatactaaattgtattgaaacattgtttttaaaagaattaggcaatgcatggaacatacttttgagtctttttccctgagtttcaaaacacaattcagttgtttcctttccaagaagtcaaacaaatattgttatttacaaactaggcaaatagcatcaagagaagaaaatatatttctttttactttttctgccactgaagatctactaacactagcagagaagaccattaatacataataaggccacattcaatgccccatgatttttattattctacatcaacttaaacaggggaattctaattcttttgactatgcacttcctctttttccattttcttttttttttaattaatgttaaaactttcagagctacaatattgcaatctattctttcaaagcactatttgcctattaaaagaaattccaccaagttcagacattaccttagcaatacagtagaatatttctctactaataaaaaaatcaactcctgcagttttaaccaacacctatgtgtaaatagtcttcttatttatatcacatttacaacatttccgctactcagttaaggtgcataagagcagaaactgtgacttctcagcactaggacctagccagatagtcattgccctgttcaaaataagtttaacaactgttaaatgacaagtttagatggtgccatctgaatcctccataagcactgcaaattcagcatttcattctcccattcttacttatctgtgttgattgcttcaccacctacccatttgttaaggtcaaaaatgttggcttcatcaatggctgtacactctcctccctttgaaattcttaccctattatttgcctagtcctacagattctctgcgaattctctattactacacaaatttagctttcattattactcatcaaaatattacttttgtctctttcattgtcaccaatagaatgccttctctaccttctccaacctatttcattataaagctagttgtgcttgctttctaaaaagtggatatgcttttgctttcctcccagtttcccctctgtttagatttttaatggctcccgattttctgtattatctaaatgctcagcatgtcctactggacttcactactacctttaaataacagctccccgaccagctcttgcctagactctccttgtgccttatatgaacaacaaatgtctctgtcttaagttggtttccccagaagcagattctgagacaaagatttgagtaccggtgctatattatttgggaaatgatcccgggaaacaacaaatgtctggagagagataaagagaaggaaagagaaccaataatttgtgccttgtcaagcaggtgttagaggtagggcaactgagttcaatctcattggggagtcctaaaagataatgaggaacactcttccttattatccaaccccaacccctcctgcctccaagggcaaggaaggtagagtgtgtattctccaatccatttgtcactggccaagaactgctactgcatacattcatcacttaccatttccagcctgcccaataaaaagaaagtctcaggtagagagttacaggtgattctagcagaatgccagaatgacatgggtaggcattgatgcaggactgattttatgcacataccacacagcctcacgtatacactattgttgtacataaactgttacttgtgtaggaactctcattgttgttgttccagtgaaattctactcaatctttaagcccaatgtcaaaagtcactctgattccatttctgaggaagaattaatgattcctcctgtacttccataatacttccttggagattaagatttcaacttgtactcatggttccacctttgtatcactatgcaatgcagtaatctccatttgacaaatcaggaaacagtcagaaagatcatgccagaaattacatgattcctaaaagttggagtgtggaactccaacctagccctcttaaaaatctactttgcccaataaatcagatatcctcaacctgaactgactatgtatctgctatattaaataattaaagaccaactggcctaaataaatgccctgctattcagagaaccagcactgcaatgtggaacagatctacctgccttataagcaagaagtccagtttctccttcttcaggctcttcactcctctggactgttcataatcatgagggtttcacaaaccaaaacaagaaccttacaaacttccacactcaagcctgcaaagacccagtatctcaagtaagcacttccattgggtcttgttgcagcatggtggacaatggaatgtggccccacagtctattagtcaatattggtctcctgctatggtcatctcactgctctagatgctttccagctgttcttcaaggaagcacactgaagcagtaagtgctcagtcctttcagtctcctacacagtcaactcagggtgttcttagttccaggcagcaggacagaatggttcaagcacctgtcacttcgtatgagtagtgctctttttccttcccttcctttgcttcttatccccatctcttgagccatcatgtcaatatcacactggttgttctttttaactctatttacaggtatgaatctcagcccacaaattcaggtgagcaagaaatctacagtctttacattataaaactttattttttgttgtaagagccgcctttctcgcatgactagtgggaaacttaaactcagtcccattcatgattttctgtcccttagtgggttctcagagagtgccttgggattaaggagtgggatctctcttatccttaagcatctgtccacacacagacagctactgagacaccctctgtctttctccacacggcccctctggcatgctggctcactcctgccaggcacacttgggacataaaacctttctctgagtttgtccatggaaaccatcttctcaaataccccatacagtcatttcctctcaggggttttccaacactcaaccttacttctgttgactgaggccttggtctctaccacacagggacttttacaaactatcttgctttctccttgcaagtggagacacatctctctagtcttacaggctttagtccagctctccctactgcttctggccaagatactctgtccagcctgccaattctctcttttctgtggggcttttaaaggacagataaactaactaataaaaagccagaaatattggagtgccatttgttctttctgctttttaacaccccttccctgagttgaatgagaggaagagatccctgagttgaatgagaggaagagaatcagagattcagggagaaaacaattctagattaatattacaaatgatttctccagatatacctagaaacacaaagaaataattatagccatttcatcccattggggttgttaactctgtccttactctacttaagctaatatcctaaatccttgtgcactaatatcctctttatatcccacttcctctccaaaatatatcctctttccctgctcctgttcttgtaggagtaattccagaaggccctgaccatcgctccccttttagggaggaattgctccctaaaagtccaaggtggttttctggctacaaatgtattctctaatgggatagtctacatgaaacaacagaaaacaaaattaaatgtgtcaattgatgtaacttgataaaccttaatatcaacatatttgctaccaaaggatgtggaaaaaggagcaggtggagattaaccagtgattaggaaacaaaattctgagtcagaacctggtcttctgtttcaaactttatcccttcatcataaaatacatgcatgtttctagataacgcaaccctttactcttttccaaaaggggaaaaatatctctgtgagtgtctattcctaaattctaacaagtgtcatcttagaaaacaaacaaaaaaaaattagaaaattgctgaacaatcctgctagctgctattcagttatgaagatcatagtcattctgttcgtgagatactctagagatgttattcagaggctgcttaggagaaaaaaaagaaaaatgcaaactgttagatctcagttaaataactgagtttattgcaatttaagctaatagttattcagtattcagtcaactatttggtgcaaacaaataaatattcttccacttgttagtccctaggggctttcttaatcctatctgaatttactttctgtgaatttctgagtaatcagaagttataggttggatacatcttgtgctagggacacccatggtgtaactgcttcattttttcttttcatttcaaaggaaatggtccatccaaagtgaaaattgttgtgttttatttttttttttggtggtagagtatattttcctctttgttggtgttgttattgttgctgttgttttaatcagatagttatttcaaacagaagcaatcaagttccttttttcactgccatctccctctacccttcctactcaatccatgctgttaagaaaatatccttgttagtaatgtgacataaagcagccttaaaaatccataattcagctgggtctagtggcttgcacctgtaatcacagcattttgggaggctgaggtgggaggatcgattgagctcaggaattcaaggctgctgtgagccatgatcacaccactgcacttcagcctgggtgacagagccaagaccctgccataaaaaaaaaaaaaaagattcaggcccggtttggtggctcacacctgtaatcccagcactttgggaggcctaggcaggcggatcacctgaggtcagagttcgagaccagcctggccaacatggtgaaacccccatctctactaaaaatacaaaaatgaggccgggcgcagtggctcacacctgtaatcccagcatcccagcactttgggaggccgaggcaggcagatcacctgaggttgggagttcgagaccagcctgaccaacatgtagaaaccctgtctctactgaaaatataaaattagccatgcgtggtggcacatgcctgtaatcccagctactagggaggctgaggcaggagaattgcttgaacctgggaggcagaggttgcagtgagccaagatctcgccattgcaccccagcctgggcgacagagtgaggttctatctcaaaaaaaaaaaaaaaaaaagattaataattatttttcatcagttcattcagtcttgtaattaattcttgctgtgatctgtattagcaatttcacaaacccatcagtttcttcattcgagttttggaattttttttttttttttgacagagtttcactcttgttgcccaggctggagtgcaacgacagaatctcagctcactgcaacctccgcctcccgggtttaagcgattctcctgcctcagactcctgagtagctgggattacaggcatatgctaccacgcccagctaatttttttgtgtttttttttttttttttagtagagacgggttttctccatgttgatcaggctggtctcgaactcccgacctcaggtgatccgcccacctcggcctcccagagtgctgggattacaggcttgagccactgtgcctggccgagttttggaaatttagttcaatagtgtgaactcaaagttattagaaacccgtacttgtcagacttcattctttccatgaagctccttgaagacataactctctgggattataattgcctgcaagaagctttcagaaagacattagactaaagcaattaagtgtggacatgaagacttcaagtgaccatggccaaaacctggtctgagtccatggtaatgacgacataattgacaagaatgttatttctgaaccaaaattgactgataccatttataccaagacacatcagatttttaaatatgttatacaatttttcagtatattaataacatatccatataaatatacctcaaggtgaaatatttcttattttgccaatccttctcttataatttattttatgtatttcttttttttttttttttgagatggagtctcgctctgtcacccaggctggagtacagtggcgcaatctcggctcactgcaagctccgcctcccaggttcatgccattctcctgcctcagcctccagagtagctgggactacaggcgcctgccaccacgcccagctaattttttgtatttttagtagagatggggtttcaccgtgttagccaggatggtctcaaactcctgacctcgtgatccgcctgcctcggcctcccaaagagctgggattacaggcatgagacactgtgcctggccttattttttattttatatttaaaatttttaaattttttggccgggtgcagtggctcattcctgtaatcccagcactttgggaggccgaggtgggtggatcacctgaggtcaggacttcaagaccagcctggccaacatggtgaaacccggtctctactaaaagtacaaaaattagccaggcaggatggccggcgcctgtaatcccatctactcaggaggctgaagcgggagaatcacttgaacctgggaggcggagcttgcagtgagccgagatggcgccactgcactccagcctggcccacaagagccagactccgtctcaaaaaaaataaaaataaaaataaaataaaattttttttgtagatacaggagtctcgatattttgcccagactggtctcaaactcctgggctcaagcaatcctcctgccttggcgtcccttgggattacaggcattagccactgtgcccagcctcatataatttaatatatcagataagcccagttgatttaatatttctttttttgtagatcctttgagaggttcaggggtcctctggaacatcctaaagttagtttgaggtcaaaaatacttaattttgatttttttttttttttgagatagggtcttactctgtcaccctggctggagtgcatggacacaatcatatctcactgcactctcaaactcttgaagcaagtgattgtcccaccttagcctccagagtagctgggtctacaggcatgtgccaccacgtccagctaattttgtttattttttgtagagatgggatcttgttatgttgcccaagtgggtctcaaactcctgggctcaagcaatcctcctgcctcagcctcccaaagtgttgggaattcaggtgtgcgccactgtgtctgccttaattttgatttttgaaaagtttgtcaaatatcaaagttttaaaacgcttgatcaaagtaggatcacaagtcactgtgaaataaaaccaaagtgagaaaatatttgaaagacacaaaacacaataaatactctttttttttttgagagggagtcttgctctgctgcccatgctggagtgcagtggtgtgatctcagctcactgcaacctctgcctcctgggtttaagcaattctcctgcctcagcctcccaagtagctgggattacaggtgctcgccaccataccggctaatttttgtattttaaggagagacagagtttcaccatgttggccaggctggtcttgaactcttgacgtcaggtgatctcactgtcttgccctcccaaagtgctgggattacaggcgtgagccaccgtgcctggtcaatttttttttttttttttttttgagacggagtctcgctctgtcacccaggctggagtgcagtggtgtgatctcggctcactgcaagctccaccccccgggttcacgccattctcctgcctcagcctcccgagtagctgggactacaggcgcctgccaccacgcccagctaatttttttgtatttttaatagagacagggtttcaccgtgtttgccaggatggtctcgatctcctgacctcatgatccgcctgcctcagcctcccaaagtgctgggattacaggcgtgagccaccgcgcccagccctggccaatgttcttgatgaaacagattctctgtttcctaggccagttacctaaaaggtaaagaaaaatcttttacaattttcttgtaaagggtagatcaatggtccacaaaaactctgttgttgcaacacaggggcccaaattgcggccttgtatccatcagtgtgcttttgatattaacgctcagtttttagcctaggcaacatgggaagacctcaccgctactaaaagtaaaaattagccaggtgtggtggtgcacacctgtagtcctgtctacttgggaggctgaagtgggagaatcacttgagcccaggagattaaagctacagtgagttatgatcatgccactgcactccagcctgggtgacagagtgagaccctgcctcaaaaaaagcttcaattttaggccaggcgcagtggctcaggcctgtaatcccagcactttgggaggctgaggcgggcagatcacgaggtcaggagttcgagaccagcctgaccaacatggtgagacccccgtctctactaaaaatacaaaaattagccgggtgtggtggcacacacccgtgatcccagctactcaggaggccgaggcaggagaattgcttgaaccagggaggtggaagttgcagtgagtcgagatagagccacttcactccagcctgggtgacagagtgaaactatctcagaaaaagtaaataaataaaataaataaaggaaaagaaagttcaatttttagaaaatcttataaatatttatggctttttttttttgagatagagtttccctcttgtcacccaggctggtgtgcagtggcatgatctcggctcactgcaacctccacctcctggattcaagcgattctcctgcctcagccttgtgagtagctgggattacaggcgcctatcaccatgcccagctaactttttgtatttttagtagagatgtggtttcgccatgttgagcaggctggtctcgaactcctgacctcaggtgatcagctcgcctcagcctcccaaagtgctgggattacaggcatgagccaccacgcctggccaaaaatcttataaataatccccttctaatttcggccagcttaatcacacaccaaattcctttcatgagattaatcttccacaacttctacacttccttaaatctttgattttgtcctatacttctttttttatattagcaatctactttaggacagaaatttactttcctttcctcttgattttgaccaaagtcctctcttatgcaaaatgaaaaattactcttttttcaactttctttaccaaaaatacatcctcatatttataactttttttcacatctctcctacttactggccttcttcccaccttgtttctatttccttcctaaatccatattttgaaacaatctttaaataacccccaacttaaacaaaattgctcttatttaacaaaaaacttatctcaaaaaacctagcacggtcaccaagcgtgctttgcttttctttctctctcttttttttttttttggaggcggattctcgctctgtcagccatgccggagtgtaaatggcgcgatcttggctcactgcaacctccgcctcccaggttttgagagattctcctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcaacaagaactgcatgctgggttctggacagaaatagagttataattaagcattcatcaggctgcattttggcccacttccttgttgctaaaagtcaggtggcactagttcctgaccattgcataccattgttcctgtagataggatttctgacattagagtcagaagactgttttaagaatttatttggggatcttctggggctgtatcacagggggaaaagtgaaattaaaaaaaaaaaaaacacaatcaatttgggctgggcgcggtggctcacacctgtaattccagcactttgggaggctgaggtggagggatctcttgagcccaagagttagagaccagcctggccaacatagtgcaactccatctctaccaaacaaaatataaaaattagccaggcatggtggtgagtgcctgtattcccagctccagaggctgaggtgggaggatcacttgagcccaggagttggaggctgcagtgagatatgatccagctactgcactctagccagggcaacagagcaagaccccaactcaaaaagaaaaaaaaaaggaatttagattaaaaaagaaaaagggctcgagtttgaatgcagtggctcaagcctataatcccagcactctaagaggctgaggtaggaagatcgcttgagctcaggagtgccaggctgcagtgagccgtgatcatatcactgcactctagcctggacaacagagtgagaccttgtctctaaaacaaaacaaaacaaaacaaaacaaaacttgagaatgggccagacgcggtggctcacgcctgtaatcccagcactttgggaggccaaggcgggtggatcatgaggtcaggagttcaagaccagcctggccaagatggtgaaacctcgtctctactaaaaatacaaaaattacagcgtacctgtaatcccagctactcgggaggctgaggcaggagaatcgcttgaacctggggggcggaggttgcagtgagccgagatcgtgccactgcactccagcctgggtgacagagcgagactccatctcaaaaaaaaaaaaacaaaaacttgagaatgatagtgttacaggaaaggggtccctacccagaccccaagtgagggttcttggatctcacgcaagaaagaattcagggcgagtgcataaagtgaacgcaagtttattaagacagtagaggaatgaaagaatgaccattccatagacagagcagccccgagggtggctggttacccatttttatgattatttcttgatgatatgctaaacaaggggtggattattcatgcctcccctttttagaccacatagggtaacttcctgacgttgccatggcatttgtaaactgtcatgaagctggtgggagtgtagcagtgaggacgaccagaggtcactctcgtcgccatcttggtcttggtgggttttaaccggcttcttcactgcaacctgttttatttatttatttatttatttatttatttatttatttatatattttttgaaacggagtctcgctctgtcacgcaggctggagtgcagtaccgcgatctcggctcactgcaagctccgcctcccgggttcacgccattgtcctgcctcagcctcccgagtagctgggactgcaggtgcccgccaccatatccaactaattttttgtatttttagtagagacgggatttcaccgtgttagccaggatggtctcgatctcctgaccttgtgatccgctcgcctcagcctcccaaagtgctgggattacaggcgtgagccaccgtgcccggccatcactgcaacctgttttatcagcaaggtctttatgacctgtatcttgtgccaacctcccatctcatcctgtgacttagaatgcctttaccatctgggaatgcagcccaataggtctcagcctcattttatccagcccctattcaaaatggagttgctctggttcacccgcctctgacaatagtagaagttaaaaaaaaaaaataacttctttaactccactccaggtggcatttcttagtgcctctgaaggttctgatctagaaccagcccccagctcacccagagcaaggaaagatcatgaaaacccaagcagaagcaagacactgggttccagcatcaatgctaagggctagaacattttctgatgttttgcttggaaaggcagaatttggttgtctagtgcgtccactaattggcctccatctgacaccctggagggatgggctgattagaagccacagctgctttgctcattatttctgatgaatggacatcacctggcgtctccggtgatggcgccagctcaggacccaggtgtgacctgcacaacaaagaaaagcaagatagctttgcagccaacatggtgaaaccccatctctattaaaaatacaaaaaaaaaaaaattagccggacgtggtggcgggcgcctgtaatcccagctactcagtaggctgaggcaggagaatcgcttaaatctaggaggcagaggttgcagtgagccaagatcatgccactgcactccagccttggcgacacagagagactctgtctcaaaaaaaaaaaaaaaaaaaaaaagatggctttacagccctgaggagtaaaccagtcttccccaaataattatcttatgtaagtcccagccccttggaacatgttttgaaagggctcacccatctgggcaggtgactcacgcctgtaatccctgcactttgggaggctgaggcaggcggatcacctgaggtcagaagttcaagaccagcctggccaacatggcgaaacccatctctactaaaaatacaaaaattagccaggcatggtgggacacgcctgtagtctcagctacttgggaggctgaggcaggagaatcacttgaatatgggaggtggaagttgcagtgagccgggatcataccattgcactctagcttgggcaagaagagtgaaaccccatctcaaaaacaaaagaaaaggctcacccttttcactggttcccttgtggcaaatctaaaataaggtacgtgtgctcgccgttcattcatctgaaaagttctaacagtttgcaaataccctctacccataccccacccccacgtgttgtccttttttttttttttttttatttgagacagagtctcactctgttgcccaggctggagtgcagtggcgcaatctcggctcactgcaagctctgcctcccgggttcacgccattctcctgcctcagcctcccaagtagctgggactacaggcgcccgccaccatgcccggctaattttattttattttatttttgtatttttagtagagacggggtttctccatgttagccaggatggtcttgatctcctgaccttgtgatccgcccgcctcggcctcccaaagtgctaggattacaggcatgagacaccgcacccggcccttttttttttaagagacaagatgtcaccctgtcacccaggctggaatgcagtggtgtcgtcatagctcactgcagcctggaccccctgggctcaagtgatcctcctgcctcagtctcccaagtagctgggaccacaggggtgtcccaccacacccagctaatttttttattttttgtagagatggggtcttgtcttgtcacccaggctggtcttaaacttctgagctcaagcgatcctcccacttggacctagccaggtgctgggattatgggtattagagtttaaatttctttgctcaacaccactccccattttgtggccaacagtcacattctttcttgggccacgtcattcattttcagttgcttcagagcactggtggccccttgggtgtgttgaacaaaccccagcctttgaggagttcaaaaaaaaaaaaaaaaagacaccatctctaggcggaaaatttcagacaaagaacccctgccaggaatatttcctgccgctgctcctgccactgccccttaggctgtggacctttatgcaagaacgcaagtggcaaactgccctactgtgtatgttgtggggagtgggggtactgccagagaggagagagccctattttattttattttattttattttaaagacagagtctcactctgttgcccaggctggagtgcaatggcacgatctcggctcactgcaacctctgccccctgggttcaagagattctcctccctcagcctccccagtagctgggattacaggcgcatgccaccacgcctggctaatttttgtatttttagtggagacggggtttccccatgttggccaaactcctgaccttatgtgatcctcccaccttggcctcccaaagtgctgggattagaggcatgagccactgcgcccagctgacagccctctctaaatctttaaaaattcagtcaggcgtggtggctcatgcctgtaatctcagcactttaggaggctgaggcaagaggaatgtgtgagcccaggagtttgagaccaacttgggcaatatggtgagaccctatcttgacagaaaatacaaaaatcagcctggcatggtggtgcacgcttgtagtcccagctactcaggaggctgaggcaggaagatcacttgaacccaggaggtcgaggctgcagtgagctatgatcacgccactgtactccagcctgggagacactgtctcaaaaaataaataaataaaatctttaacaattcttcagcttatccccctaccttctggggcttcttgggtctcttcccagaaactttcttcgtctgtaagcccgtttattgtatgcaattgtttaaaaaacacaaatgggtgcatattctcatattctctaccctctattttgaacgttccttttttttctttttttcagaccgagtctcagtctgtcacccaggctagtgcaatggtgcaattttggctcactacaccctctgcctcccagattcaagcgattctcctgcctcagcctcccgagtaggtggattacaggtgtgcaccgctgcacccagctaatttttgtatttttagtagagacgaggtttcaccatgttggccagactggtcttgaactcctgatctcaggtgatccacctgcctccgcctcccaaagtgctgggattataggcatgagccgccttgcctggctcaaagttcctttttggtttaacaatagatctaggccactgtgagtcttcctcattccttctagggctacctagtgttccggggttatttaaccagccccctcctaccaggcagttcttttgtctctggccctttgctacgtatattagtttaaagttcactttgcaagtggccaaggctgtttccctcatttccaggttcccagggggcagacatcctgctgcaatttcagaagtcagcacactcttctctctcctgtctaaaatacaaaagtccatgccccccactctccctcttgatactgtcctattttacttcttttcacaaccagaactctttatttttcccaaataaaaatagtccgtcttttcagattttaaaaatggaactctggccggatgcggtggccctcacctgtaatcccagcactttggaaggctgcagtgggcagattacctgaggtcaggagtttgagatcagcctggctgacatggtgaaactctgtctctactaaaaatacaaaaattagcccggatgcggtggctcacatctgtaatcccagtactttgggagaccgaggtgggcagatcacgaggtcaggagttcaagaccagcctggccaacatggtgaaaccctgtctctactaaaatacaaaaattagctgggcatggtggcatccgcctgtaatcacagttactcggcaggctgaggaagaattgcttgaacctgggaggcggagtttgcagtgagctgagattgtgccattgcactccagcctgggcgacagagcaagactccatctcaaaaatatatatatatacaaaaattagctgagtgtggtggtgcatgcctgtaatcccagctactcgggaggtgaggcaggagaatcacttgaacctgggaggcggaggttgcagtgagccgagattgtgccatttcactccagcctggacaacaagagcaaaactcgtctcaaaaaaaaaaaaaaaaaaggaaaataaaaatccctgataaaggatcaatgaccttaggataatgtcattccaggtaagtatctttaactgggtacttggtcctccaagattcagaggaccttgatccccctgaaactgtatacataatattcaacatacatagtatgtgcacacatgtgcaaacactcacattatctaaaattcatcataatcttaccccggcttctccccatactcctcagatcctgctatagcctagtgcattttctccttcctcactcccttccctccatgtgtcctctgccctggccaccaggaactttgtgctgcctccggagtgcatgaggcactttcacatctctcttgctttacaagagcttccctatgctccaactggcaaatttctctatggactgaaaaacccacatagcctttatctgtcttgtgatgtcttctccccaccctcaagttaggcatacccttctatgccctcctttatccaaacattttccccactatatcgtaattgtgtgtttaagtgccggactttccaactagatacaaagctttcccaggaaagaaatccttttcttttcttctttctttcttttcttttcttttctttctttttttttttttttttttgagacagattcccactgtgtcgtccaggctggagtgcagtggcacaatcttggctcagtgcaacctccacctccagggttcaagtgattctcttgcctcagtcttccaagtagctgggattacaggcacgcgccaccacacccagttaattattattattattattttttttttttgtttttgagacggagtctcgctctgtcacccaggctggagtgcagtggcacaatcccggctcactgcaagctccgcctcccgggttcacgccattctcctgcctcagcctcccgagtagctgggactacaggagcccaccactacgcccggctaattttttttttttttttttttgtaattttagtagagacggggtttcacagtggtctcgatctcctgccctcgtgatccgcccgcctcggcctcccagagtgctgggattacaggcgtgagccactgcgcccggcctccacacccagttaatttttgtatttttagtagagacggggtttcaccatgttggccaggatggtctcaatctcttgaccttgtgatctggctgcctcggcctcccaaagtgctgggattacaggcgtgagccaccgctcccggcgagaaaccttttctttttcttttttcttcttcttcgtctttttttttttttcttttgagagggattcctgttccgtcgcccaggctggagtgcaatggcgcgatcttggctcactacagcctctgcctcccgggtttaagcgattctcttgcctcagcctcccgagtagctgggattacaggcacgagccaccacgcccggctagtttttttttggtatttttagtagagacggggtttcgccatgatggccaggctggtctggaactcccgacctcaggtgatccgcccacctctgcctctcaaagtgcagggattacaggcatgagccactgcgcccagccaagaaaccatttctgattcacctattcactcccgcactcccactacacagtagctaaataaataaataaatattaaaaataaataggaaagaaagagagaaaaaaagaaaagaaaaagacaaaaatttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcgggggggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggaggagtttgcttcctaactctgcttccctgctttcctgtggggggtcttcccaggagttcctggggccctgggtcactttttggggtgcgtaaggggtgccgaaaaagatttagaactcggttcccttttctggagctgcgctttcatcgcgactgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtagactttctggtagccaccatccgggcttaagccatccggatagcaagccctctgattcggttgctctgtgaccttaaatatttaccctctctggtgtgttgatttcctggatgcttagctgccagactggcttatgaagtccttttagagttttctgtaaaagggctcaggccaggcacggtggctcatgcctgtaatcccagccctttgggaggccgaggtggaaggatcatttgagtccaggaatttgagacaagcctgggaaacgaagaggattcctgagatcactgtctctataaaaaatcagatgggcgtgttggtgggtgcctgtagtcccagctacttgggaggctgaggcaggaggatcgcttgagcccaggagttggaggctgcagtgagctgtgatcacaccactgcactgcagcatgggcgacagagggagaccccgtctcaaaaaacaaaaaacaaacaaactaaaaaaacgaactttttttttttttaagaaaagggctcagagccaggcgtggtgactcgagcctataatcccagctactcgggaagctgaggcaggagagtagcttgaacctgggaggcggaggctgcagtgagccgagatcacgccactgcactccagcttgggtgacagagcaagactccgtctccaaaaactaataataataaaaaattttaaaaagagctcagggtttttttgtttgtttgctttttgttgtttcttcaaccatctccttgattgttaagtgggtggaggaagactgttgtacctcgtgctccacccaggctattggaaaataaatctggtgattttcagtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggtgagagccatggggacttgaccttgctgccttctctgtctggtgcagagaaggtggggattggggagggtggaatttgaggtctgcaggataaacgtgtgccctgggagttgactgttgattgccacctgtctcaaataaattgcagtggcgtcttgccactgcttctcctgtttaactaactagtcttagaagatgctttccactttaagacatgctttatgggatagaagacacaagtcacgatttctgcatttgaagtggcagttttcatttcttttgttgcataaacccttactgggtgccagataagatctctgtcttttgggagtgcattgtttggtggaaaagacaaagcagagtcagtgacaaggtgttgtcagtgtgatatatactgagctgggagaaatcacaaggctctcctacccacatccagaaaggggacggttagagggaaggtcaggaaggcttctggaaggtggtagttgaggggggttgtgaaggaggagtaggacttagaaagtggggcacagtcgcctgggagaggagtcagcgtttgcaaagtcatgaagctaccgggacacagctgggctactgtaagtagctgagtatgtaatagaggaggctggaaaagcaggcagagggctctgagcgaggagggttatgtgggccatgccaagactcgggagtggaaggattttaggagatttccatgagggtcattttattaattatttttttgagttggggtctgcttctgctgcccaggctggagtgcagtggagtgatcatagttcaccacagcctcaaattcctgggctctggggtagctgaggtgcctaccaccatacccgactaataattttatctagagacagtgccgctctacgttgtccaggctggtctctaactcctggcctcaagggatcctcccatcccagcctcccaaagtgctaggattacaggcctgagccaccgtgcctggcctcgtgagggacattttaaaggagcacactggaacatgtggaatgggtttagactggattattcgctttgtggcggtcttcttacatcatgccagcttcttcgtggggagaggcaggtgagtggttttgccctcagttgcttatagtctagttgaagagataaagtggacatagagaactgaaaaggaacttgctaagagggtgttttctttcattctttttgttgttgttgttttgttttgtttgtttactttttgagacagggtcttactctgtcacccaggctggagagcggtggtgcaatctcagctcactgctcaacttcacctcccaggctcaagagggtcttgtgcctcagcttcccgagtagctggacttacaggtgcacaccatcatgcctggctgatttagagggtgtttgctttctgctgggcacgtccaggcatcgtgggaagtgctgtttaaattgggccataaaagggtgggtaaggtgaggacaggggaccaagtgggtgggattcagggtggagcagagtcatgggggtcgggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggtgtgtaaaagacaggatcagaacgttagttcaggaagcttaatcttttctgcccccccatctgagatgtacaagagggttagaaagcagagttggagaagctgtttgggagggagcacttatttgtttttttgttttgttttgtttttttgagatggagtctcgctctgttacccaggctggagtgcagtggcgccatcctggctcactgcaacctccacctcccgggttcaagtgattctcctgcctcagcttcccaagtaggtaggactacaagcacctgccaccatgcctggctaatttttgtatttttagtagagacggggtttccctctgttggccaggctggtgtcgaactcctgacctcaggtgatgcacccaccgaggcctcccaaagtgctgggattacaggcgtgagccactgcgcccggcagggagggggtaaagtgagaggcataagggtcccggccaggtgttagcagggggcttcagaggtgaggagagagcagggcaggcagctgctaggcctgggggagcgggctgcggaggactgagaatctgaggtttttctcttggccgcctgggggaaatccagggggaaaaggagaatgaggaaggaagatgcgtttggcctcagacgtgttgaaggtattaagaggccaacaggaaatgaggccatgggctagagagaagagccctgattcattccccaaatgcctcccgaaattctgtgcgccgaggcttgtgtttggcacttggagtacaaagatgaattcagcagtctctttggtgtttgccttatcagctaagctgagaacaagattgattagtacacactcctcagtgttcatgcctgacctacttttccttatttagtaagttatttttaataaatgtagtaagttctggcaatctaggcacccaaaacaaaagctgggatcatgaaacaaaagtatatatctaatcttttttttttaattttaaaaaactttaaaaagttttctactttatcaggtccccttagaacatctaatcatttcatttgaacttgttttctgttcttaccctgaggtaatcattatctcctttctttcattttttttcttagttttatcttacatgtgtatttctttgtttctctgtctcttttttttttttctttgaggcagagtttcactcttattacctaggctggagtgcaatggcacgatctcggctcactgcaacctccgcctcccgggttcaagctactcccgattctcctgcctcagactctggagtagctaggattacaggcatgcgccaccatgcccggctaattttgtatttttagtagagacagagtttctccatgttagtcagactggtctcaaactcctgacctcaggtgatccacccgcctcggcctcccaaagtgctgggattacaggcgtgaggcaccacgcctggcctatttctttctttttttagagacagtgtctcgccttgtaacccaggcagctggagtgcagtggcatgatcacggatcactgccgccccaaattcctgggttcaatggatccatccccttcagcctcctgaatagctgggactacaggcacaggctaccatgcttagctaatttttaaagtttgtgcagaggcagcttcactgtgttgcccaggctggtgttgaactcctgggctcaagcaattcacccgccttggcctcccaaagtgctgggatgatagacatgagccaccatgctcggcagtgttcatctttcgtagctattgctagaccatttcctgaatgaagtgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgattttaatccttcgtgtctattgcaaatatcttctcccagcttttaacctattattcctctttctttaaggtgtcttctgttgatcagccattcttcattttaacatagcgaaatgtattttttccctagtactcagttttctgggtctggtttgaagtcttttcctgaacataacccttgcctttaaggagcgtatgcattctccagtggaggagacagataatggcactgagacgtcatgtgggcattgattgttagaagtggccacttctgcctgtggagcgggagcgaacttaggaaagatctcacagggcagagtcttgagctaggaattaagagatgagtaagtggacaagtgcgatgggcattctcagtgggggacgaagggcatgaaacatcctgacctgccctgggcgctgccaggaggtccagatggcaggagctgatggtttgaggggctcgggcagggcatcccgaggacagctttgggtgatctgtatgcaagggaatattgaagccatgggaacagatcctgaggatccgggcggaatggagagaggaggggaggaggggagagggaggccagggcctgattcccggatgcagagaatgttatcaacgcctggtgtggctctggggagcacctgggacttcccaggggcgggtgctgttggcatgctgcctgctgtgctgttggatgctgtatttcacccttaggtgttgggcaaaggctgacatgtctgcagagggcagggcgtgttgttggcaaagctagccagaggcagagcactctctcactttttgatagagacatgagttcagagaagtattgctcaactgtaggagtgtgaaagtacagtaatagatgtgagggaggccacagggcagaggtctgcaaacgatggaccctcagccaaatctggcccactgccatttttttttttttttttttttttttttttttgagatggagtctcactctgttgccaggctggagtgcaatggcacgatctcagctcactgcagcctccgcctcccaggttcaagaaattctcctgcctcagcctcctgagtagctgggattacaggcaccagccaccatgcctggctaatttttgtatttttagtagagacaaggtttcaccatgttggccaggctggtctcgaactcctgacctcaggtgatccacccccgcttggcctcccaaagtgctgggattataggcgtgagccaccacgcccagcattttttttttttttttttttttgaggcagggtctaactcctgcccaggctggagtacagtggcacagtctcggctcactgcagcctccgcctcctgggttcaagtgattctcctgccccagcctcccaagtagctgggactacaggtgcacgccactacgcctggctcatctttgtatttttttggtagatacggggtttcactgtattggccaggctggtctcaaactcctggcctcaaatgatccacccacctcggcctcccgaagtgctgggattacaggcgtgagctaccgcattcagccccactgcctgattttgttcataaagttatattggtatgcaacccctcctgtttacacattgtttatggctgttcttgtggtctagtggcagagtcactggaaagactttttctgtcctttacaggaaaagcatgctggccctagccatagggagtcgtggtagctgtggccacccagagaggacgttccagccaccattgcagtttagctggtgttgctaggtagatcatggatctaggtccagcctgcaaatattgccatcttttctgattttcaagggaagcttgaaatctagatttttttttttttttttactgtgaatattccttttttttgagacagattctcactctgtcgcccaagctggagtgcagtggcataatcttggctcactgcaacctccacgtcttaggttcaagcaattctcctgcttcagcctcccgagtaactgggactacaggcgctcgccaccacacttggctaattttttgtattttttagtagagacagggtttcactgcattagccaggatggtctcgctctcctgacctcatgatctgcctgcctcggcctcccaaagtgctgggattacaggtgtgagccactgagcccggccaaatattccaatttttaaacatcagctcagtttttaaaagccaaaccttagtaacccaagcaaaacacatctacaggccagtttgtccgtcgtcagtctgtcttggtgggaaagacaggaactctggaaacagatttgggttttctcagcccctggatatccttgggcaagctgcatgtcttctggtgactcacttttctcagttgtggtatggaaatatcccgcttccccagttgtgaggaccaacgagaattactagtcaggtggaggggcttagcacggtgcctggtgcctggtaaacctttacctggtagccattgctgttattcatttatttatttattttacacaataatttacttattgagagccttctctccccgcccttgcagtctctaggtcactttttccacttgtagattttgtgcccaagccccagaaagatggctgggggcaggggctctgcgtactattcgatgagacccataacgtggctgtaactgtctttctcatactgcaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgcttttcttgggcataaatatctgatttctggtttccattcggtctttttttttttttttttttgagacggagtcttgctctgtcgcccaggctggagtgcagtggcgcgatcttggctcactgcaaactccacttcctgggttcacgccattctcctgcctcagcctcccaagtagccgggactacaggcacccgccaccgcgcccggctaattttttgtatttttagtagagacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttgtttaaagagacagggtctcgctctgttgcccaggttggagtgtagtggcacgatcatagctcactgcaactttgaacccctaggctcaaagcagtccttctgcctcagccagtcaaagtgctgggatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacacagcggtggtggtggtttggtttatatttatgaccttttaaaagtgtttggcattttcagggaggtttgttttttgttttgttttttgaggctcatgttgcccaggctggagtgcaatggtgcagttctcggctcactgcaacctccgcctcctgggttcaggggattctcctgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaaaaagaaaaaaaaaggtcttctatcgtttctccactcaaagacagctgttaacattttattgacttctatggagtttgccctatgcttctgttttatgtaatagagacagtgctgtagtgaatagcttcacgtcaacatttttctataattttctgaagttagagtcttaattattggatcaaaggaagtgaacatttttaaacctcttgatacatatattaccaaattgtttgcttttccgttttttttaataaatagagatgggggtctctctgtgttgcccaggctggtcttgacctcctggcctcaagcgatcctcttccctccacctcccgagtagctaagattataggtgtgagccaccatgctcagccgctgattttaacttgtatgttttaaacaaaatttctagtaaagtagaacatttctttgatatgtttgtgtcaggatttgactctcccaggtctttggagaggctttctaacaaggcatcccccgtgggtggccatctgccctgtgagaaggtcatttctagttccaggtcacgcacagtgtgtcagctggtggggtgtggagtttcaggcccaggcctcctggaaagtgcccgaaagagaaacggcttagaaaataaggactttaacggtggtgtgggttgagtttggaaagtttagaccatgttagtggaatcagagctgggaagaggttctagaagttacctcctctcactggtttccagtccacacttctcagaactctcccattttgcagtcaggtgcagtggctcacatctgtaatcctagcacttgaggagaccgaggtgggcagatcacttgaggccaggagtttgagaccagccctggccaacatagcgaaaccccgtttctactaaaaatacaaaaattagccaggtgtggtgtggtgcacacctgtagttccagctactcaggaggctgaggcatgagaatcacttgagcctgggaggcagaggttgcagtaagccaagatcgcaccactgcactccagcctgtgtgatggaaggagactctgtctcaaagaaaagaactcacctattttgcaaaggagcttcatggttctcttgaagaaaaataggaatggaggccacctctgtgtcaaaaacaacatcccacatttctgtgtttcactttttttttttttttttttttgagactgagtttcactcttattgcccaggctggagtgcaatggcgcgatctcggctcactgcaacctccacctcccgggttcaagcgattctcctgcctcagcctccctagtaggtgagattacaggcatgtgccaccacgcccggcaaattttgtatttttagtagagatggggtttctccatgttggtcaggctggtctcgaactgccgacctcaggtgatccgtgcctggcttacttttttttttctttttctttttcttttctttctttctttttttttttttttttaagagatagggtcttgctatgttgcccagactggtctcaaacgcctggcctcaagtggtcctcccaccttggcctcccaaaacgttgagattacaggtgtgagtcaccacgcttggcgtgttttacatgttgacggacagcatataatcacatgtataagggtttctgcttgtaaaagtctggaaacccattctaactgccagaatcacaaaacctagagaaggggacataactgccctgtggccacccagtagcttttatcttctctcgcgacggcagaggcaggacagccagcattctggtgaggattgaaggattagttgtaagagatttcagcaggtctgcagtgatcagatgggtttctcacatattgttaagttgaaagtagccgtggctcagtatgagttgagtacctgtttaaaatctgcattcaaagccttcttcccagaggccacaactgcagtgagatccaagtgtgtggctcacccgccccggggctcacagctgggcagggtgatttccactcaaattcttgtgccagtgcagatcttgttctaaagcttttctaaatgcctggagactagaaagacttttggatacttttccctttttcttttggatgaaatttcatctccagtagaacagcagcattccatggtgcctcagccacgatcctctggagagagatttgcggcgaagacctgacgagagactgtaaaggaaaagcagggtttgtttttcctggtcaaagttgttaatactaaaaaaaaaagaagaaaaaaaaactttggccaggtgcagtggctcacgcctgtaatcccagcactttggaaggccaaggcaggtggatcacctgaggtcaggagttcgagaccagcctggccaacatggtgaagccccgtctctactaaatacaaaaaaaaaaaattagccgggcttggtggtgggtgcctgtaatcccagctacttggaaggctgaggcagaagaatcgcttgaacccaggaggcggaggttgcagtgagccgagatcacgccattgcactccagcctgggcaacaagaatgaaactctgtctcaaaaacaaaaacaaaaacaaaaaaaaccctttgatcattaaaaagttatatgactattttagaacatttgcaagtacagaaagaggtaaagaaagaatagcccaggtgcagtggctcacacctgtaatcccagcactttgggaggctgaggcgggtggatcacttgaggtcaggagtttgagaccaacctggccaatgtggcaaaaccacatctctactgaaaatacaaaaattagccaggcgtagtggtgcgtgcctgtaatcccaactacttgggaggctgcagcaggagaactgcttgaacccgggaggcggaggttgcagtgagccaaaattgcactgctgcactcctgcctggcgacagagcaagactccttctcaaaaataaaaaaaagaaaaaaaatcccataattctttgattccagtgacattttagtgttgttctttccagacttttaatttttaattaatttatttttatgagacagggtctctgtctgtcacccaggctggagtgcagtggtgcaatcatggttcactgctgcctcaacctccagggctcaagcaatcctcccacctcagcctcctgagtagctgatactacaggcacgcaccaccacaaatggctaatttttctagtttttgtaaagacaggcttttgctgtgttgcccacgctggtcttgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccccggagcagaaggctcacccctcctttggtgtttcagagcctctgggatattgggcacctgaagaactgcagccgcagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtgggtatcaaaggtggcgggcttggtgtgagtaggaacagtggctggtcatggaggggcttgtgtgccttgtcatcctctggagtctccagtaccctcctagggcctgggccatggcgcgccctccattggggaggctgcgtgccttcgtggaaagttttagctgaagtcctcgcctatatttcccaggctgttttgcagagttgtgagagttggttcatcgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcctgcccgcccgcccgagggcactccaggtctgatctttggggcgggttgtgggcttttgtcggaggaattggcagctccgtggcgggcctggcacccacagagctgccaattcctgtgttcggagttgttgcaggcctgactcacctgtgttctcatgctgtgtactcagggctgcccttgtggccgttcctccttgagactgaaagggtgggcaagtgctaggggtgaggggccaggagaggcagggaggccaagatgggttgactctctgctgtatgcctagtgctgtgtgggcaccttatacacacccgtctgtgttatcctcatgaaaaacacttaggatacatgttgataactgcattttcccaaagaaagcaagcttggcgagcttagatacttccatcaagatgatacaatagccaggcatggtggcgcgtgcctgtagtctcagctgggtgacagagggagacccctgtctctacaaaaaattaagagatcagttgagtatggtggcacatgcctgtagtcccagctgctcgggaggtggaggcaggaggatggctttagcccaggaggccatggggctgcagtgagtggtgattgcggccactgcactctagcctgggtgacagagtgagactcggactctaaataaataaataaatgaataaataaataaatgtcaccttttattaagtagtgtatgtgtgaccttgagttattcaaccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgagcatacacatcatattttatccccattttgccaatgaggaaactgagacccaggtagttacagtgacgtcctcatagtcgcgtggcttgtgataagatggggaccctggcttctggtgtggtcccagactgtactaccccagcaaggtttcagtgagaagggtaagaccaccttccctggaagggagacagatgtggagcagcacctggaaagaagcaggcctgggctctggcatcagtgtgcacacacactgcatcagctctgatttttttttttttttttttttttgtagaggtgggacctcttgtcactgaggctggagtgccttgggattatagctcactgcagcctctaactcctgggctcaagccatcctcctgcctcagcctcttgagtagctgggactattggcatgcacctccgcacctggctaacttttaaattttctgcagagatgggatctcactgtgttgcccaggctggcctcaaactcctgtgctcaaaccaccctcctgtcgcagcctccctaaacactggcattacaggtgtgagccaccacacccagtccccttgacctctttcagccttggtttcctgtccgtaagtgggagaaatgtcaccttggcagtctgtgcagcttaggagagacaagtacatttgatgttggttactaaatgttggaccctggaccggcactccaacagccggtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgagaccagcctggccaacatggtgaaaccccgactctactaaaaatacaaaaaattagctgggcgcagtggtgcatgcctgtagtcctagctactcgggaggctgaggcaggagaatcacttgaacctacgcgggaggtggaggttgcagtgagccgagatcacacgcctgggtgacaagagtgaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggtggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctaggagtttgagaccagcctgggcaacacagacatcatctctacaaaaagtaaaaaaatgagctgggtgtggtggtgaatgcctattgttccagctgctctggaggctgagttgtgaggattgcttgagaccaggagtttgaggctgctgtgagccaagatcacactgctgcactctagcctgggtgagagagtgagaccctgtaaccaaaaaaaaaaaaaaaaatcagctgtggaaaagcatcacgtgtttcccctgcgctgaggctgactctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggtaagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccgaccacagaggttgaagggttcctttggccggcaggccagcatggaggtggtgcgtcataggagttcagagggccctgtcccaccactcagtggctgtgtgccctgggcaggcaactgcgcccctctgcgtgtgtgcgtttctgctttttggtctgcgatgtgttttgatcttttttttttttttttttttttttttttgagacggagtctggctctgttgcccaggctggagtgcagtggtgcaatctcggctcactgcaacccctgcctcctgggttcaagtgattctcctgcctcagcctcccgagtagctgggattatagacatccgccaccacacctggctaatttttgtatttttagtagagacggggttttgccacgttggccaggctggtgtcgagctcctgacctcaggtgatctgcctgcctcggcctcccaaagtgctgggattacaagcatgagccaccgcacctggacctgcagtgtgttttgatcagtattattgagaatgaggcaccagtttcctctcggagccatcccttactctaatctggtggttgtcactgggggtgattttgtccccggggccatctgacaatgtttggagacactgttggttgttacagctgagtgggtgggaggtgggggtgctcctggcatctggtgggtggaggccagggatgctgctcgccatccggcagtgcactgggctggccctgcagtaaggaattattggcccacagtgtcaccagtgaggaaacttgagaaactggtttttccttttttttttcaattttaattttagttttattttaaaaagtatgggttttttttatcgtgtttgtttgtttgtttgtttgttttttgtaaagactgggtctccatcgccctgtgttgcccaggctggtcttcaactcctgagctcaagtgatcctcctgccttggcctccgaaagtgttgggattacaggcttgagccgtcatgcccagccctggaaactgtgtttccaggagtgtcgtagagtctgtgaaaactgtggctgtcagtcagctcccaagtcattgccttcacagtgtgtgaagtcaactgacaaagatagcagacaggataaataataacatggaaattgcatatcgtggcagagagcaggaagtgttaatcggggaatgaaagtggcaggtgttgtagaggtcgatttgaagttaggtgggtgtggtgtcatgtgcctgtagtcccagttatttaggaggctaaggcaggaggatcgcttgagcccaggaggtcagggtggcagtgaactatgatcacatcactgcactgcagcctgggtgacaaaggggtaccctgcctctaacaataaataaataaacaaatagcagcatgactgtgtacctactgtgttcctatttgtttattttggcggttgaaaaaagaatttgaacgttccctgtatcttggggatgctagcagactaacctttggttttcctttgaaaacaggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcaggtatcgtgggcaacggccgctcgttttgtctgccctgtgtttctgctcttagctgggaagactcaccccaattcctgcagatgcggctcctgccccctaggtggtcctgccgtggcatctcatttgcatgtggcatgtgggtgccgaggtgccgtggccgtccagagcctacctgaccccttgtacctgagtcctggcagtcaccacacgggttagaatctacagtcctttcactcacgatgattaagggcctccacatggagcagttaaaggcctgtggcctctgcttgcgggctgcatggcgagcattgtgcccgagaacactgggtcactgcctgtacactgactcccgccttgtgccaggccctaaggacccagagaccagagtatcagcccttacccctgagccctagtctagtgcaaggggctgtcagcgcggtgtgagggagggcagaatgtggagcacgtggcagtggctgcaggtggcacgggtgacctggcccccgtgatgatgcagcccagcccagagtgcctggtagagcgctcagctccttgagagagagagagaatgataccacgggcccagtgcagaccagagcgggtggcatttaaaatgaggagattggtcaggcacagaggctgacacctttaatcccagcactttgggaggccaaggcaggaagatcatttgaacccagcagtcagagaccagcctgagcaacatagcgagaccccatctccacaaaaaaaaatttttttaattagccaggcatagtggtacacacctgtaatcccagctacttgggagactgaggcaggaggattgctggagaccaggaggtcaaggcagcagtgagctgtgatcgcgccactgcgcttcagccccctaggtgacagagcgagaccctgtcttaaagctgggcccagtggctcacgcctgtagttccagcactttgggaggccgaggtgggcggatcacctgaggtcaggagttcaagaccagcctggccaacatggtgaaaccccatctctactaaaaatacaaaaattagccaggcatggtggccagcgcctgtaatcccagctacttggaaggctgaggcaaaagaatcccttgaacccaggaggtggaggttgcagtgagccaagatcgtgccactgcgttccagcctgggcaacaaagagcgaaactccatctcgggggaaaaaaataaaaaagataaaatgaggaacccccccaggatttccctggatttggccaaggtgaatgggctggccgtagccctctgactgtctgggtgacttggggcttcgtcattcattattgagaatgttgggcttggagcacattttgagaattcagagtggtagctgggacagggctttctgagagtgccctggtgcgggtggtgagggagtgggtgggcctggggccgccctggtcccagggaggaaatcatctcctttctccgcactggccctggtcggcatcctgctgcctccctgctcaccggcccacccctgcccaccgcagccacatcaagggctgaaacttcacagggtggttgagaccgccttggcagcttcttggacctctagtatttgttcagactgggtttccgaggaccctgccagcttgtgtaagacacagtgacagcgcctcccgctcattggttcgtgtcatgtgccaggccctcctgagcaggctgcttgagtgacttcactcatcccacgatgctctcaggctgagcagtgttcttcgcttacaggagagcacattcaggcccatgaggttggcgacacagccagcaagtagcggagctgggattcagcccagaccccaagagtgggctatctggggcacatggggagttattgacattcccgggaaggcagggggctcttttaatacattttaattttattttattactatttttaaagacaaggttttgctctgtcacccaggctagcgtacagtggtgcaatcatggttcactgcaggcttgaactcctgtgctcaagtgatcctcctgcctcagcctcctgagtagctgggaccacaggtatacaccaccacacccggctaatttttcagttttacgtagaggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttccggggcatcttctgccaggagttggggcacgtgcatctgagatctttctgggagttgggagtataggaaggtgtcatcggggctctctgaggacatagacataggcaagccaggctcagggagatgctcccccaacttccctccctgagtatctgggtcagcctgtttcagagaacagtgtgctctatctgctggcccaggagggttcttagaggtgctgggacttctgtcagccctgttccactcagcttcctggagcttcttaagttcttaggaattattttgaggcaaatttctagatagtgctagagctgggattctggagttaagtcatttaatgtggatttgttcctttctcctggtattgggcctcgttggtctttcctaaaccatttccgtttctcccagtatttctctggggtccccgtccctggcctgagggcccccagaagtgctgatgtgggtcctaccggtgtgggccaggcaagttacagaaaagaaggtggatgggccagtctgtcttcccttggtgctggggtgggcatgctgtggcttgccccacgttgtaagtcaggagggaaccaggccagcaggctctgttagtggaaacagcctcaaaggggcctgcctcctggggtaggtgtaggtgcatcctgattcctttggttttcttggagctgggagaggtgtaattcacctgcacgagcctatctacgcgctgaaaaacaggcttttcccctgcctgatttgtagtgaggccccctgcagttaaccctcctctgacggatgtagagccagatggggcttagtaaatacctgacctcttaacctagcaggcggcaaggttctcacagccaagtgcatgtcaacagcatcaggtgaaagttaccttggatgtgaggaggcaggcagggcaggcagggcccgtctagagccagcgccatgggctggggaagcccgagaaccgactttttactggcagccactggaaataccatgtgagcgcgtgaaattgaaaaatttcctggaactcacgtgcacagcttccacgtgccccctgggaacaggccgtgatacaagaaagcgtgtcatctggggctgagctgctgggtggcagtagatttcctggtagctgaagttgatccctttaagcaccaaaacttgtgttttaatgatgttggatggaaatctttcctaaatgtgtcatgcatgctcttgtctcccttaatggagagagtgtgacactgcttagcacttggatggcttggggtggtggttatgaccagcagtctgtcacagctcagcgaggtgaagcctgtgggcgttttgctctgtgctgaatggctcagtggccctgcaaaacggcgctcagctcttggtggctttctgttgtggtgggctgctgctgctgctgctgctgctgctgcccttgcctctaaaagaactcacttcctcttcctcctgctgccacctgtcttttggcttgtgggattggagtcatggggcccagatggagccttgctcctgacttatgataggccctcggtctcttttcttctctatttttttcttctttcttttctttttctttgttttttgttttgttttgttttaagagacagggtctcactctgtcacccaggctagagtgaagtggtgtgatcgtggctcactgcagcctcaaactcctgggctcaagggatcctcctgcctcagcctcctgagtggccaggactacaggcttgtgccattgtgcccagctaattttttaaattttttgtagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcaccactgccctggcggcctttgggaatcatcctcacaggtagaggaattgaggctcgggaaggggacttgccatgctcagcacacacggctttgagcgggagcatacgcctctagcatcgtctccagcctctgcagctcatgggactggctgccagccccaatcccagagggtgtggacttggagaggggctttggatctccttcctctccggcctcctggctttgcccctcgccctgcatagaaaactcggagtcctcatgtctcacgtttcccactctgtctgggatctcctggagatggtcacagacaggaaagccagggagggcctaataggtggaccaggagttggggagaggaggagggtgcctgaggccatgactatagggacttctcagagaaggacacttcaggaggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctccattcacagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatacaaaaattagccaggcgtggtggcgggcacctgtaatcccagctactcgggaggctgaggcaggagaattgcttgagcctgggaggcagagaggttgcagcgagccgagatcacgccactgcgctccagcctggatgacagagtgagactccgagaaaaaaaaaaaaagtggggggaagagttgaaaccagctgaggaaggggaggagcttgctccaaatgaatgaaactgagtgttcagtagagtcaggaccttgacccaggtgtccagactccctgcccttcttagcattatcagggcccccagatccactaccagccttgcctttggatcgggagtaggcaaggagagcaagaagctgctctttgcttagcacggccacagaggcaatcctgtttgagaacagtcaacaaacaaactcaaacaggccatgcacagtggctcatgcccataatcccagtgctttcagaggccaaggtgggaggatctcttgaggccaggagtttcagaccagcctggacaacatagcaagattctgtctctctctctatatatataaaattagccaggtgtggtggtgctcacttgtagtcccagctactcaggagggtgaggcaggaggatcacttgaacctgggaggtggaggctgcagtgagctatgatcgcaccattgccctccagcctgggtaacagagcaagaccccaactctgggcccagcatgcttccagtgtgtcactctaccggcatgaccctacctcttaaaaaaaagaaatatgatgacttaagaccaaatgagtggccaggtatggtgtctcatgcctgtaatcccagcactttgggaggctgaggtgggcagatcacctgaggtcaggagtttgaaatcagcctggccaacacggtgaaacccctgtctctactaaaaatacaaaaattagcagggtgtggtggctcatgcctgtaatcccagctacttgagaggctgaggcacgagaattgcttgaacccaggaggcagatgttgcagcgagccaagatcatgccactgcactccagcctgggccacagaacgagactctgtctcaaaaaatccaaagaccaaatgagtgacttgaacataatcattgtagggaacacaaccctcatattaaaaaaaaaaacaacaacaacctttattttatggtaattaagttccggaaaagttaacaaaagtagttgggtttccatatctccctcatctggcttctgacattaacagctttcataaccatggttcagttgtcagatccagaaaattaccactggttggctgggcacggtggctcactcctgcaatcccagcactttgggaggccaaggcaggcggattacgaagtcgagagatcaagaccatcctgggcaacgtagcgaaaccccgtctctactaaaaatacataaattagccgggtgtggtggcacgcacctgtagtcccagctactcaggaggctgaggcaggagaatcgcttgaacctgggaggcagaggtttcagtgagccaagatcacaccactgcactccagcctggtaatagagcgagactccgtcccctcacccccgcaaaaaaagaaaattaccactggtataatactcttaactaaaggttttttttttctttcttgatttttcaccaatttcccactactgtcctctttctgtcccaggatccaatccagggtcccactttgcttccagttcttattctccccgtcctcctctgggctggaacagtttgtcagtctttatctttcataaccttgttactttcaaagaggtgctttgttgaatgtcccttaatttgagtttgtcttgttttcccatgtttggacaaagataatgccctttgttatttcttttttgacagagtctccagcctgggctggagtacagtggtgagatcatagctcactgcagccttgaactcccaggctcaagtgatcctcctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgatcatttgctaaagtggtgtctgccaggatttttctcctctaaacaggtgctatgagaacctgctttttttttttttttttttttttttttttttttgagactgagtttctctctgttgcccaggctggagtgcagtggtgcgatctcggctcactgcaacctctgctgcccgaggttcaagtgattctcctgcctcagcctcccaagtagctgggattacaggcgcctgccaccatgcctggctaatttttgtagttttagtagagacaggattttgccatcttggccaggctcgtgttgaactcctgacctcgcgatccacccaccttggcctcccaaagtgctgagattataggcgtgagccactgcacccagccattttttttttttttttttgagatggagtcttgctctgttgtccaggctggagtgcagtggcacggtctcagcaacctccacctcctgggttcaagtgattctcctgcctcagcctactgaatagctgggactacagctgtgtgccagcatgcccagctaattttttatatttttagtagagatggggtttcaccgtgttaggatggtatcaatctcctgaccttgtgatccacctgcctcagcctcccaaagtgctgggatttcaggcgtgagccaccacgcctggcctgagagcctgcattttgatgacactagtgagtgtaaaatatctttttttttctttttattttctttattcacaacaggtatgaaatgattgttttcagagtcttttttttttttttgagacagggtctcactctgtcgcccaggctggactgcagtgatgtggtcatggctcactgcagcctcaacctcctgggttcaagccatcctcctgcttcagcctcccaagtacaggtgcgcaccaccacacttggcagacttttaaaaatttttttggagatggagtctcactatgttgcccaggctggtctcaaactcctggcctcaagtgatcctcccacctcatcctcccaaagtgctgggattactggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccagggagcgtccctgccactgtgcccatgcagatgccaaagcccagcagagtccagcaggcgctcgcaggtaggtgcctgccctcgggctgcagagcagtctgtgccctgcgggacttggtggggaggaaattgtgatgtggggccttgtcaccctctggatcctcagggagagccagaggggctccctgggggagcagtgcctctttctggtgatggtgtcaccccagagtgagcccaggtgcccctccttttgctctctgggtacgtgggcctgatgacggtgggcgctcgggtgcagaccttttcacatcctttaacatttttgcattgaattgcattatatttaaatagtcactttcctgtcctgaaatactttaaacatttccttaaaggggccctctggggaattaatagatctatttcggctgtagttactcttacatcttgaataagaggcaccttttgggtccaaccagatcttttgctgtactaaccatacatcttacatcttggaactgttttgggtttggtttggttttttgtgagacaagagtctcgctctgtcacccaggctggagtgcagtggcgctaacccagctcactgaagtcttgaactcctgggctcaagcaatcctttcaccttaaggatccttaaaaatacctactgctggcccccacacccattctgttttagcagcctggctagcagggttttcagaagctccacaggtggcaggattttttttcttttttctttttttgagatggagtctctctcgcccaggctggagtgcagtggtgggatctcggctcactgcaacctctgcctcccaggttcaagcaattctcctgcctcagcctcccgagtagctgggattacaggtgcatgccaccacgcccgggcaatttttgtatttttagtagagatggggtttcgccatgttgaccagtctggtcttgaactcctgacctcaagtgatccatccgcctcggcctcccaaagtgctgggattacaggcatgagccaccgtgcctggccattttttttttcttgttataagtgacaggatcttgctctgttccccaggctggtgtgcagtggtgtagtcatagctcactgcagcctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctgccacgcccagctgaggttattttctaacttctggaaagttcgaggtatgtaaggaggtggatggcgccatcgttgttcacagggtgatgtggcggaattcaataatgagttggtgttttaggggagttgctgtcgtagtggctgagaggggacaggcctggaggtagggcggctggtgcagagcctgacctcagacctgggggcaccagccaaggcctgaccagcttcgaggcagtggagttgagggggaggtttggcttgaaacattcagaggcatgagccgtcaggcggggggttgtgaggggggattgggggtagactgaggcctgctggagtgcagccagtgacaactgaggagcagcctggggcttggcgtgtgtgaattcatttcgtccttaaatcactgaggtggaggcttttgttcccattttcattagaggaaactgaggctcggagaatttaaaaattctctgccagcccttggcagagctgagacacagccccgggccttcttgcctatgacggttcagtgctgctgagtctagggggaggttgggagggggtgatggctgtggagtggccgttggagctgttccggggcagtgggatttggctgtgggcctcagaagagcagtcttgggtggaatggggtgcccctgacccctcgtgggagcgtgtgtgccacagagaccgtgggcgggactgaagagaaaatgaaggagcggccagagaggtgggggcaggagggagaggagctggagcggggcaggggagacagaatgagcaagacacactggccagaaagtccctgctcactgaagtcaccgtgcggcgccgtagggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctgagtgccctgggtgtggagttagcacctgcccccttcctctgctcttgaggctgaaggtcctgtccaggctgtgtcccaaattgtccatcctgttgtctgtccccgttgctctcagagcaatcctggagctaaagcaggtattttaacatccattttacttgtggggaaatagattcgggaagctggttcaggcctaaggaaataggagagcctggaggctgtgtggactcctgcctcccccaattcaaggcccagtgttggtacctactgggggagcattgtctaggggagcagggaatgagaggagcctggccagcaccccggagccagagctggagagcagtgtcctgtcaccctggtgtgcttgtgggttgaggaattataccatgcccggctgcggagatgagcgtttgcgcacagggtttttgcagggaggtttataaccaggaggtcatgctttggaaggactgagtgctggaggcactgcttccaagtgacagtgcctccaggtgacagctcccctggctgtggcatagcccagtccctctatcgggtgggggcagggactgtgaggctggagccagggtctccacccctcacctggtcacagcagcggtccatccacagctcacactgctgcctggggcagggatgggtgtcagcagcctgcccaggactgctcagctggtgagggctggcactgggctcgaacccaggctggggaggtcagagcgcacagaggagaggcttggatctcagccctggccctgggtgtcagaaggaggggtgtctgcaaattggaagtgagaatcagtgagtgggggcttcactcttcagggctctgacagcgggaatcctcccagatgggtggagaaaaaggctgtggccctccgagttattcaggtgatttgggggctgtcaggagtttggggggttgtccctagccctcctcctctccaggcttctgggttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagtacggcggggcgggaggcttggagggacaggccccgtcaggcagtgttcagggaaggcctgcccgccgaggcagtgttgccggagaaccctgggtagggagacgtgtcctggcctttggtcctcccagacgacgtgggcagcgcagaggcaccaggttctcttgaggaaaattgcacctgtccctgtcctctcccatctgtctgccacccgcgcccgcttgtccttctctccacccgacattcagttcccacaggaaccgcatttgagcccaggaacaagcttgggatgttgggggcattgagctcccgggctcaaacctctgtcctctgatgcacgctttggtgtctcctgctgagcggccactgcaactcaccctgcccacctcggctctgctgcccaggctggtggctggtctccgcttctgtccccacagccaggcacatgtgccgggttgagaagctttgttcttctagtgggggcgcagtggctggcctggccgcccttcacccctgagtcacgccatctgttcctggatggggagtggggtccaggaggactgggatctctaccaactcccccggcagccggctgtgcccagctcctgagccaggttctgcagaccctggaagccaccttaagggatggctaagaagctctgggcttcccctttctctggagaggaggtgcttttgacctaactgaccgatgacagggaggaccggggagctggcactatggaaagtggggtaggccgagggtgtggcaggaacgggttcgtccagcaggacacgctgtgtcccaggaagcgctgggtcatcagggagcacgaaggaagcagtgtcagaggagagtcccccagggcaagtgtggggttccctgcaggcatccggcagtggtgagctctggaaagagtggccggtctgtcccagcatagctgctggccacaggcccacccttgcccgagggcgccagagccacagcctggggccttgctgcagcccagccctcacagtatggggatgctgcagtgtgggagcaggcccaggggccacgttcctgcccgcctaccccagcgctgtcgctgaaggccctggcacccagatcagccaggaggggcatggagcacacacagcgcccagtggaggctggaggcctagtaactccaagccaggagggcccagggcctcctggggaagctgagcccttggagccagccccacccaggagaccccgtgccccgggcggcttcctggagtggcgtcctccgccctctgctctcctgaagtcacgggtcctgccccggtgcccacctgcacactgagggcacgggcttgtctgttgctcctatagaaacctgtgggctctggggccagggctaccatgagccaggctgccccaccctctgattcctggcctgggtagtccccagggagacctgtgcgtccccgtggccattgatggtgtcacatccttggcctgagcagggtttgttggcgtcacatgccgaaggagtcttctaatgtctctccctctctgcgtgtctgctctcacgcccgtgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggtagttcttgttcccaaaagctctctggcctttgctaagcctccttccggcctcgctgcctccgactcttctgcacagaccctcttccttctctctgctccctgactcctgggggaaggggctcagtggcccttctccctgcccccgctcggcagcagaggcggcccctggaagctgactttccaccgcagccccagagttcagctcctctcctccagtcacagctggcatgagggggcttgttcttgaggactttgtgatttttgtaagcagcaagttgtgggtgagaggcggcgcccggctcaggatgcggggacaaccgtcccttccgccagggccagcacgtgtctcgggaaaggcccccagacagcggcccaggtctgctgcccaggtctgctgccctgacccccagccctgtgtggccgccacgtgggctgcttgagaggggtccctcggtgacccctgccctgctcgttgcatggccacagaagaaggggctttaggaccacagcaggtccagggagttacagcaagacctgctcggagcagcctgtgatggtcaagttctgaacctttcccaagcgggtgctggccctgcttccacccctgggctgtggaagtgtggactgtggccagtccagatgctcttgagtgggcgtggtggcgggcagggagggtggccgtggccctgctggccctcagtgtctgtgtcatctcagcaggtcctctcggagcctccgcttagcagaggggcttggcgaggtctaggaaatactcgaagcgcctggcatgcggcaagggtggcttccgatcgtgtccgacctccagcccacaggcgaggaggtgggctcagggaggggtgggcctcgagctcctgcccccagcccagggctctgcacgccctgcccttcccctgccctgggggaggagccagactcgttggcagcccggctggcaaccttctgtggcactcgggtttacctgggaaggacacgctcttggtgggtcgcctggctggccccttctgagacacgtggctaatggaaagctcccttctgttctgaaaagctgcaagggctggggtgggtgggcgggggtgggatgctgtgcccggcctcaccagggctgggcagaggcgaggcccaggctcacccggagatggctctggagttggcaggcttttccaaaggaaaaggcccccctcagcctgagtagggcattccagccacacggagggtgaccctgagctgggggccatcgttctggtctggcgttctcgccaccgtgacaggatttgggttcgggcagtctgtatgggtgtgtggaggtgtgggggtgtgtgaggtgtgtggaggtgggtgtgtggggtgtgtagaggtgagggtgtgtggggtgtgtggaggtgagggtgtgtggggtgtgtggaggtgtggggtgtatggaggtgtggagtgtgtgtggaggtgtgtggaggtgtggggtgtatggaggtgggtgtgtggggtgtatggaggtgtgaggtgtgtggaggggtgaggtgtgtagggtgtgtagaagtgtgtggggtgtgaggtggggtgtgaggtgtgtggaggtgggtgtgtggagctgtgtgtggtgtgtggaggtgtgaggtgtgtggaggtgtggggtgtgtggagctgtgtggggtgtatggaggtgtagggtgtgaggaggtgtggaggtgtgtggtgtgtggaggtgtggggtgtgtggaggtgtggggtgtgtggagctgtgtggggtgtatggaggtgtaggctgtgaggaggtgtggggtgtgtgaaggtgtggggtgtgtggaggtgtggggtgtgtggaggtgtgggatgtgtggggtgtgtggaggtgggtgtgtggggtgtggagatgtgtgaggtgtggaggtgtgtggtgtgtggaggtgtggagtgtggggtctgtgaaggtgtgaggggtgtgtggaggtgtgggagttgtgtggcgatgtgtgtggggtgtgtgtgtggaggttggtgtgtggaggtgtgtggtatgtggaggtggggatgtggggtgtgtagaggtgagggtgtgtggggtgtgtggaggtgcgtggggtgtgtggggggtgtggaggtatgcggtgtgtggaggtgggtggtggtgtgtggggtgtctggaggtgtgtggggtgtgtggtgtgtggaggtgtggggtgtgtgtggtgtgtgtggacgtgtggtgtgtgtgtggagatgtgtggtgtgtggaggtgtggggtgtgtacaggtgtggggtatgtggagatggggtgtgcaggtgtgtggaagtgtgcaggtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtggggtatgtggagatggtgtgtggaagtgtgtggtgtgtgcaggtgtgggggtgtggaggtgtggggtgtgtggaggtgtggagtgtggggtgtgtggagttgtgaggtgtgggtggagttggtgtgtggtgtgggatgtgtggaggtgggtgtgtggaggtgtgtgggatgtggaggtgtggggtgtttggaggtgtgtgggatgaggtgtggggtgtgtggaggtgtgggatatgcggggatgtgtgggaggtgtgggtggagttggctgtgcgtgggggggtgtgggtgtggattggggtgtgtggtgtgtgtataggtgtggtgtctttaggtgcggggggtgtggattggggtgtggtgtgtgtaggtgtgtctgtaggtgggggtgtgggtgttggtgtgtgtgtggaggtgtggggtatgtgggggtgtgtggaggtgggggtgtgggtgttgtgtggggtgtgtgtggggtgtgtggaggtgtggggtatgcggggatgtgtggaggtgtggggttgtgggtggagttgggtgtgtgggtgtggaatggagtgtgtggtgtgtgtataggtgtggtgtctttaggtgtggggggtgtggattggggtgtggtgtgtgtgtaggtgtgtctgtaggtgggggtgtgggtgttggtgtgtgtgtggaggtgggtatgtgggggtgtgtggaggtgagggtgtgggtgttgtgtggggtgtgtgtggggtgtgtggaggtgggtatgggggtgtgtggaggtgtgggggtgtgggtggagttgtgtggggtgtgtggaggtgtggggtatgtgggggtgtaggtggagttgggtgtgtgtgggggggtgtgggtgtggattggggtgtgtggtgtgtgtgtaggtgtggtgtctaggtgtgggggctgtgggtgtggattggggtgtgtgtgtgtaggtgtgtctgtaggtgtggggggtgtgggtggaggtgtggggtgtgtggatgggggttggggggtgtggtcttgccagcagtttccctccaggtcacagcagccatgccatcacagcaattccagcttggttacatattcgtctttcccgtttgagatcagggaaccgaggctcagaggtggcatgattcgttcacagcaagagaactagaattaaacaaactgtgccgactccagcctccgccccaccacgccacctccctgccaaactgtcccctccctggccctttttggtgtaaagggagttcagcaggtgcagctgtgcgccctcaggcttagaggcttagaattctctgcagcacctaaaggccgtgagcttggattcaaaccagagccccttctggtcctggagtctgggacgaccgcagccccaccatgaccttggggtggagcccctgtcaggagcgcctccacgggtggcactgggctccccgtccctctttcacccccgcacgggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaacaactccacatggaaaggacatccgccccatcttgcttgaagggtgcttcccaggtgcctctgggtgccagggccttgctccagcccctttggtttcatctcccagcctcccgagacccacatcgttatgatctgagctttgcacttaaggagctgtggtcctgagcaaagcccctcctctcccggccctggcctctccatagcctgatggccatcctgggagcaggaattccagagacaagggatgggccagcctgccccactctccaccttgcggatgctggtgtagaagtgaggtggcctcgtccaggtggctgtcctgtcccccggctattgggagagctggtcaaggttcttataatttttttattcttaaagacgggtgcacactgtcacccaggctcagtgcagtggcgtgatcacagctcactgcagccctgtcctcctgacctcctgtaatgaacaggaccaatcagactcctattgcgcttccatagaacctgaacctctgctgagccacgttttgggggctgcagcaccactttcccctgattttagctgggagcccgggagatactgttgggggagggggtgggcgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcgtcctcatgtgtcccaccccttccacaagcccttgccacattcccgcctgcccagcgctcagctctgtctcggccctggtgtccatctggtgtgactgggccgtttcaccccaggctcctcctctccaagctgccgtctgcacagccagcacgcagcttggatcatgggagcactccctgcctggaacccccagcaggacccccaactcacacacaaccccaagcccctgagtgtggcagccagacccccgagggcgcgcctctccctgatcctgtctcatctcctgctcccagcccaccccctgccagctttagtgcccatgcgctggctcctcgttcagaacgtcctcctccctcttccgggtgcccactctgtgcttgtccatctggcaattcctgtctcccttgtaagaccccactccgagggcctcccccaggatcctgccctgtccgtccttcccatttggtggcttctgctgtcatgtcgggcctgtgctgctggtaagcccttcaagggcacaggtcccggtgactcacctgtgtctccagcctgtggaatggactttttttttttttttctgagacggagtctcgctctgtcgcccaggctggagtgcagtggcataatctcagctctgcaacctctgccccctgagttcaagtgattctcttgcctcagcctcccgagtagctgggattataggcgcctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctcttttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaactgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcaccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatggcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattcccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctttccatggcccgtgtcaatgccggtatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgtattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcacctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctgtacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccttgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcaagcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttggtgctcaggggcaccaccaggagaggcctccggctgaggtcagcttcccagagaggaaggtaagggactgtccctagctcaggactggcacccaccctgcagagagccacgccttcctcaggagggctctgctggacagagacctgatcaagggcgtctcccactccttcaggatggagacaaaagcccaactggtggccgagagtggtggcttatgcctggaatcccagcacactgggaggccaaagcaggaggatcacttgaggccaggagtttgagacgggcctgggcaacatagcaagaccctcgtctctattaaaaatataagaaatatgccagacgcggtggctcatgcctgtaatcccagcactttagaatgctgaagcaggtggatcgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtctcaaaaaaataaaagaaattgaatacattgatattttgccaggaccctgccttctacaggcatctagtctaatgggactggcagtaaccaaggcagatgagctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaagaagcagtgaagccgagccaggaaataccaagatggcgagccagtgtgcttgtagagattgtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcgagtgatgcgagggggacctgaactgtggcctctgtcatgggaacccagaggaggtcgatggcgtttgtggttgatgtgggaaggagagagagagagaagaaccagaaacgtctgcttgctggaggaagcggcatgtccgctcctccactccttttcttttccccttaggagcggtttatggttccttttgttttattcttttatttgtacactggcattggagtttgtttttttggcttttttttttttttttgagaaaaagtctcactctgtcacccaggctggagtgcagtggctcgaccttaacttactgcaacctccacctcctgggttcaaagggttctcttgcctcagcctcccaagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatctgagaagccagaggaagggttttgggtgatgctcccaggatggtgggctccgatgggatctttggagggggtgtgtctaggtcggctggtgtcaggagggtcttttgtgtgccaggcagagaactgtcccaaggagctgagagtagaggggccaggagcttcagggctgcagccagactgtggcccagggctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttcttgatttttatttttatttatttattaatttattttgagacagagtcttgctctgtgggccaggctggaatgcagtggcctgatcttggctcgctgcaacctctgcctcctgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctttttttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacacccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttctttttttttttttttttttttttgagacagcgtctcactctctcacccagaatggaatgcagtggcgctatcttggctcaaagcaacctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtccttccctggtctctggctctctgagtccctccttttttgttttgttttgttttgacacagaatcttggtttgtcacccaggctggagtgtagtggtgcaatctcagctcactgccacatccatctcctggattccatttattcttctgcctcagcctctcaggtagctgggattacaggtgcctgccataatgcccagctcaattttgtacttttagtagagacagggtttcaccatgttggccaggctggtctcaaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccagtctcaagtgattctcctgtctcagcctcctgagtagctgggattacaggtgtgcaccactaccacttgactactttttatacttttagtagagatggggtttcaccatattggccaggctggccttgaactcctgacctcaggtgattcgcccgcctcggcctcccaaagtgctggggttacaggcgtgagccaccgcacccggcccccttccttcgtcttagtcaaccctatcccacctcttcttccaccagtcccctcacctgatggtcccaacacttcatcatccaccacctcctggagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaatttttttttgataaaaaataaaagagttacatgacattcagagaccatccaaaaaacctgtgggttcccggctgggctcagtggctcatgcctgtaatcccagcactttgggaggccacagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctggtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttggtgacctggggctgggtgggcctctgagagcctttatagctgattgccttttgggagagggcaggtgggagccccaccctgtctcatgagtcaccccaaaggtgcatgggcaggcaggtgctggggaatcggctactccccagagcttggcgtggccatccctctggcccctctgggagtctggagcccattccctcacactggtactcactgcagctggggacatctgcactaggaagacaggacacggcatggaagctggcctctgcccagaagccatgacattctggtcaccagcctgatgttataaaacgagtgtcatggccgggcatggtggctcacacctgtaatcccagcactttaggaggccaaggcgggtggatcatgaggtctggagttcgagaccagccgggccaacatagtgaaatcccgtctctactaaaaataagaacattagccaggtgtggtggcacatacctgtagtcccagctcctctggaggctgaggcaggagaatcacttaaacccaggaggcagagattgcagtgagccgagacgacggcattggactccaggctgggcaacagagcatgactccgtctcaaaaacaaacaaacaaaaaaaacgagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagatcagcctgggcaacatagcgagcaccccatctccagaaaaaatttaaaaattggctgggcgcagtggctcatgcctgtgatcccagcactttgggaggccgagggggatggatcatttgaggtcaggagtttgagaccagcctggccaacatggtgaaaccccgtctctactaaaaatacaaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaacctcccccaaccaccctcagctcaagcaattctcatgcctcaaccctcagcctcatgagtaactgggactacaggcgtgcaccaccatgcccagctaatttttgtatttttagtagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctggatagccccctacccacatgcctcagcattgggaggtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtcgactaatgacccttgtccctcccctcagctgcctctcttttttctttttttttgcttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcgaactcccgacctcaggtgatccgcccgcctcagcctcccaaagtgctgggattacaggcatgagtcagcgcacgcagcccatcttaagctttttttttttttttttttttgacgaggtctctctctgtcattcaggctggagtacagtggtgccatctcagctcactgcaacctccacctcccaggttcaagcgattctccccgcctcagcctcctgaatagctaggactacaggcgtgcaccaccacgcccagctaatttttatatttttagtagagacagagttttaccacgttggccaggctggtctcaaactcctgacctcaggcgatccatgcacctcggcctcccaaagtgctgggattccaggcttgagccaccgcccctggcccatcttcactatttttaagtggacagcacagtagtattaactatatgcacatcgttgtgcaatagatctctggaactttttcaccttgcaatactgaaaccctacactcaacaaacaactcgctttccctgccccgctccagcccctgaaaacttctactctcctttctgcttctgtgaattgtactattccagatacctcccataggttgaagcaaccactatttgtctttctttgtaactggctcatttcacttagcattatgtcttcaggtttcatccatcttttagcatgtgtaagaatttccttccttgctttgtttgtttgtttgtttgtttgttgagactgagtttcactcttgtcacccaggcttagagtgcaatggtgcgaacttggctcactgcaacctctgcctcccgggttctcttgcctcagcctccagagtagctgggattacaggcgcctgccaccatgcccggctaatttttgtatttttagtagatatggggtttcaccatgttggccaggctggtctcgaactcctgaccgcaggtgatccacccacctcggcctcccaaagtgctgggattacaggtgtgagccaccacgcctggccttgtttttgtttttgtttttggagacagagttttgctctgtcgcccacgctggagtgcagtggtccgatcatacctcactgcagcctcccctcctaggctcaagcaatcttcctgcctcggctttctgagtagctcaaactacagacacacactggtcatgaaatccttgcctaagccaatgtctagaagggtttttctaatgttatcttctagaatttgtacagtttcaggtcttagatttaagtctttaatccatcttgagttgatttttgtataaggtgagagatgaggatccagtttcattctcttacatgtggctagccagttatcccagcactatttgttgaaaagggtgtcctttccccactttatgtttttgtttgctttctcgaagatcagttggctgtgtttgggtttatttctgggttctctattctgttccattggtctatgcgcctattattataccagtaccatgctgttttggtgatgatggccttaaagtatagtttgaagtcaggtaatatgatgcctccacatttgttctttttgcttagtcttgctttggctatgggactcttttttggttccatatgaattttagaattgttttctctaactctgtgaagaatgatggtggttttttgatggggattgtgttgaatttgtagattgcttttggcagtatggtcattttcacaatattgattctacccatccatgagcatgggatgtgtttccatttgtttgtgtcatctatgatttgtttcagcagtgttttgtagttttcctcatagaggtctttcacctccttggctaggtatattcctaagtacttcatttttttttgcagctattgtaaaaggggttgagttcttgatttgattctctgcttggttgctgttggtgtttagaagagctactgatttgtgtacattaattttgtatctggaaactttgctaatccttttatcagttctaggagctttctataggagtctttagggtttttgaggtaaacaatcacatcatcagcaaacagtgacagtatgacttcctctttaccaatttggataccctttatttccttctcttgtctgactgctctggctaggactttcagtactgtgttgaagaggagtggtgagagagggcatccttgtcttgtttcatttctcagagggaatgctttcaacttttccccattcagtattatgttagctgtgggtttgtcatagatggcttttattacattgaggtatgtcccttgtatgccgattttgctgagagttttaaccataaagagatgctggattttgtctaatgctttttctgcatctattgagatgatcatgtgatttttgtttttaattctgtttatgtggtgtatcacatttattgacttgcatatgttaaaccatccctccatccctggtatgaaacccacttgatcatggtggattgtctttttgatatgttgttggattcggttagctagtattttgttaagaattttagcatctgtgttcatcagggatatcagcctgtagttttcttttttagttgtatcctttcctggttttggtattagggtgatgctggcttcatagaatgaattagggagggttccttctttctctgtcttgtggaatagtgtcaataggattggtaccaattcttctttgaatgtctggtagaattctgctatgaatcagtctggtcctggacttttttggttggtaatttttaattaccacttcaatctcctgcttgttattgatctgttcagggtatctaattcttcctgatttaagctaggaagtttgtatctttccaggaatttatccatctcttctaggttttctagtttatatgcgtaaaggtgttcatagtagccttgaatgatcttttgtatttctgcccccattttgtttcttattgaggttatttgaattttctctctttttttcttggttaatcttactaatggtctatcaattttatttatcttttcaaggaaccagcgttttgtttttatcttctgaatttttttgtttgtttcaatttcatttagttcttctctgatcttggttatttcctttcttctactgggtttgggtttggtttgttcttgtttctctagttccttgacgtgtgaccttagaatgtcagtttgtgctctttcagtctttttgatgtatgcatttagggctgtgaactttcctcttaggaggaaaggtggcctttgctgtatcccagaagttttgataggctgtgtcactattgtccttcagttcaaagaattttcaaatttccatctggattttgtttttgacccagtgatcattcaggtgcacattatttaatttccatgtatttgcatggttttgaaggttccttttggagttgatttccagttttattccactgtggtctgagagagtgcttgatataatttcaactttcttaaatttattgaggctcattttgtggcctatcgtatggtctatcttggagaaagttccatgtgctgttgaatagaatgtatcctgcagttgttggatggaatgttctgtatatatctgttaagtccatttgttccaagatatagtttaaatccattttttcttcattgactttcagtcttgatgacctgtccagtgctgtcagtggagtaatgaagtccttcactattattgtgttgctgtctgtctcatttcttaggtctattagtaactgttttataaatttgggagctccagtggtaggtgcataaatgtttgggattgtgatattttcctgttggacaaggtcttttagcattatataatgtccttctttgtctttttcttcttcttcttttttttttttttttttgagacgtagtctccctctgtggcccaggctggagtgcagtggcgtgatctcagctcactgcaacctctgcttcccgggttcaagcaattctgcctcagcctcccgagtagctgggattacaggtgcccaccaccacgcctggctaatttttatatttttagtagagacagggtttcaccatattggccagggtggtcttgaactcttgacctcaggcaatctacccgcatcggcctcccaaagtgctgggattacaggcatgagccactgcacctggcccttctagtcttttttaactgctgttgctttcaagttagtttttctgatataatagctactcctgctcgcctttggtgtccacttgcatgaaatgcctttttacacccctttaccttaagtttatgtgagtccttatgtgttaggtgagtctcttcaagcagcagatagttggttggtgaattcttatccattctgcagttcttatcttttaagtggagcatttaggccatttacattcgatgttagtattgagatatgaggtagcattccatttgtcattttatttgttgcctgtgtactttggttttttgtttttgttttttaaattgtatttttgttttataggtcctgtgagatttatgtcttaaagaggttctgttttgatgtgtttccaggatttaagatttagagctccttttagcagttcttgtagtggtggcttggtagtggtgaattctctcagcaattttttgtctgaaaaagactgtatctttcatacacaatgcctagtttcgctggatacaaaattctcggctgataattgttttgtttgagaaggctgaagatgggccccaatcccttctagcttctagggtttctgctgaaaatctgctgttaatctgataggttttcctttatcagttacctggtgcttttgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgatttattcctatggttgttctggagctaaaatgcatgacacgagcctctacacgctgctctgtccgtccgagtcagagccgcaatctagtcttttaaagggctctctccacctttaaaaacccttacctataagccatctgagagttcaagtgttaagtataatctgcctgattctccttgcttggtccctacaaacaaaggctttcccttctcttgctacaagccttggtttagatatggtatagatacatagtcttattacgctgggcgagtggacctccgtttggttcaataacaaaatctgaactgaggagagttgtgattacactattgcatttcatcataaatattttccttgttgaatccaagcacacaaagtacagaatgatcctcttcctcagtacagtttttccctctgttatactagtaccatgatatcctcagctgaagaaaaggtgctagatgctctgtaccatctgatctttttgtcaggtgcttttctgatgcaaattattctctgaattcttatctctccctttcactctgagccataatcttgtctatgtcctggagctcattgcgtttttcccagaacacagttgagtattcaaggacctcccgtaagctttttccctcttcttctcttgctatattttcaatatcacaaccccattttaattagctttgataagctggttaaaatctctgagttcaattggtaaatccctgtgttaactctatctcttcatcaataaggggttcagcttatttaaactgttctttttctgtgcctatgctgcatttggtaggtcgtgattttgaggtaccttgtacccagttgcttttctgtaatacagagtttctttttctagtaattaaaataaatgttgggccagatgcggtggctcacgtctgtaatcccagcactttgggaggtcagggtgggcagatcacctgatgtcaggagtttgagaccagcctggccaacatggtgaaaccccatctctgccaaaaatacaaaaattagctgggcgtggtggcaggtgcctgtaatcccagctacttgggaggctgaggcaggagaattgcttgaacctgggaggcagaggttgcagtgagccgagattgtgccattgcactccagcctgggcaacaatagtgaaactctgtctcaaaataaaataaataaataaaatttaaaaataaaataaaataaatgtggaggaaagaactggaaatcctgaaatttttgttttttcaactttttcttcttttttaatacaatttagcaccaataataaagcatcaataatagtaaggcttttctacatatctgagatctcttccttaatatattatttatcacctccccaataatatatttgttacttatggagtgaaaagccttcaacctatttccttttgcagcaatagaggccaagcacagtgttactgctctcaagaaaaagaacacacaagcaatttcagcttagaaacaatacttaaaagggaggacagtttataaaattccatctaggttgcttgaaaatagctttctctatcttgccaataagtaatttactgaaacttctttgtactttgacctgaatctgtggagactctattctattaataatttgtaaagtttataaattccttcctacaaaagtttttcaacatatattggaatctggggtttcaaaagccttcctccttatttacttctctttgccaattaaaatcacacactgtttctttgaccaagaaatgggaaaatgactactctatccctatacactgtggcttccactaagtgggaggaaaggcttcctaggacatgtgtttaactctgtaatttgctctcgaaactgctgccccaatgtacccaaatatatgaatctctatgttctttttatttaacccaaaatatacctgatctattctgcactaaatatcaacaacaaagacagggctccaggaagtaacttgcagaattgtcttgtttaaaaataggattaacaagcttcttggtaaggtgagctttttcctgcctccctccccactcccacttctaaccctgtaacattctttgtttatgtacatttggttcagagggatacttctgctgctgccttattattaataatagcagattaaacttcagtgcctcagggttggaggattctcttttatactacaaacactttgggccgcccactataggaagtgccatgctaagtatattagggaggttcaaaagatgtgaaaagacacaccagtgctctcacaaagcttaccaactcactaggaaaataaatcatacactatgaaacaacatgaaagtaattactctgaaattttattatttttaacacatacatttcacaaacaatacctttaacaccacatacaattccataacaaaatattttaattttgtcaacgttcttttttgtttgttttttgagatggagtctcgctgtgtcactcaggctggagtgcagtggtgcgatctcggcttactgcaacctccgcctcccaagttcaaatgattctcctccctcagcctcctgcctcagcctcccgagtagctgggactacagccgcgtgccaccacacccagctaatttttttgtatttttagtagaaatggggtttcaccatgttagccagtatggtctctatctcctgacctcatgatctgcccgcctcagcctcccaaagtgctgggattacaggcgtgagccaccgtgcccagcctcaacgttctttaactttttacaatcttctctcaacaaaagtgtaacccaagataccttgacaagaaatcttccagataaatatttttgagctagtttcaatgatgcctatccactaaattttctctcaaatacttgcaataataataaagtcaacagtactctaggcaagagtatactgaggaagtacacaattaatcagttcttcccaaaaaataatcgtaatagtttcttcctcaaatcttttcttctgcaatgtctaatctcatccattgtatttttcatctcagacactgtagttttcatttatagaaattcaattttggtcttctttttatatcttccatgtcttaagtgtttgaacaagtgcaatacagttataataacttttattttccttctctgctaattcggtcatctatatcagttttgggttagtttcaattattctcttcattataactcatgggtttttttgccctttgcatgtctgataatctttgattcaatgctagacagtgaaaccacctctgcaaaaatcataactgagaaaattattacagtgaaagagatctgacataaccagctccatcttgcttctaatcaccaagctgtccttgttcatttctaggtacaggctgaactaacttttgggaggaatttagtttatagtttagctttgaaaccaagacaataacagccatttcccaaacaaactccattcctgcctggggactagactcccttttcaggacaacaaattagccaaaagattagaaattgtggtttaggagtcatgtagctggaagctgcccaaattgctaaacctccccaaattgctcctgcggataacatcactattgtaaaacctaagatcagtgcttgaaatattttgcagaccctaaactcagtcgatcggctggcataacccagattgataagctggctcatctggtcttgtggcccccagtcaggaactgactcaacacaaaaggacagctctgactccctatgatttcatctcagactgactaatcaaaactcctaactcactggccccctatcaaattatccttaaaaactcagatcgtcagattctcagggagactgatttaagtaataataaaactggtctcctgcatagccagctctgcgtgaatttctctttctctactgcaattcccgtcttgataagttggctctttctaggcagtgggcaaggtgaacctgttggatgggttacaacattgtgaattttactttgttgggtgctggatatttttgtattcctgtaaatcttgagctttgctcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactccatcttgatctccctaactcagggagtgttctagactccagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttcttttcaccctcttttttaacttattttgaaataatttcatactgacaagttacaaaaacagtagagagaggttctgtatacccatcactcagttcccctaatggtgacagcttctataagtatactgcactatcaaaaccaggaaattagctggcaaattaactggactatagaccttactcagatttcaccagtttttacatgcattcatttttcgggtatgtctttgtatatactcatgacattttatctatcacatatatagcttcatatataaccatcattttaatcaagatatggaactgttctgtcactacaaaggaagtcccttgtcatgtccctttaaagtcatactctccttctccttccctaacctatggcaaccacttgtctattctctacatctttaattttgtcgtttcaacaatgttatataaatggaatcatagagtatggaccattttgagattggcttttttcactcagaataatgcccttaaattcccttcaagttgtttacatcaacagattgttccctttgtcggtgaattaccttatgtggacataccatgagtcatatgaacattcagtaatggaaggatatttaagtcatttccagttttttggctattacaaataaagctgtgaacatttgtgtacaggtttttgtgtgaacataagttacatttccccaggataaatgcccaggaatataaatgctaggtgattaatggtagtttctttttttttctatttttttaagaaactgccagactgagttatagagtagctgtatcattttacattcccaccagtaatgtagaagagatccagtttctctgcacacttgccagcatttgaataatcagtatttttaatttttgccattctagtaagtatgtagtattttattctggttttaatgtgcatttccctaatggctagtgatgttaatatctttttgtgtatttatttgccatcatatatcttctatggttgcactgtttcttaaaagttacaagattaaacttctgtgtgcacgaatcatgttttcttcactactggggatagttcacttaggataaggatttggctatggtttaatatttcttgaatgaccaaaataaatacaaagacaataataaaacaaaaccccacaggcatcacaaacagaactcataatgctctgagattggggcctgcactttgaactctagtctagggatcagcaaactatagctcacgggccaaatctggccaggggcctgtttttgtatgccctgaaagctaagaagggcttttactttttttttttttgagacggagtctctgtcacccaggctggagtccagtggcatgatctcggctcactgcaatctctgcctcctgggttcaagcaattctccctgccttagcctcccgagtagctgggatttcaggcacccgccaccacacccagctaatttttgtatgtttagtagagacagggtttcgccatgttggccaggctggtctctaactcctgaccttaggtgatccatgcacctcggcctcccaaagtgctgggattacaggcgtgagcgaccgtgcccggccgggcttttacatttttaaagggttatttaaaaacaaaaaaatatatgcaacagagtccatatgtaatctgctaagtctaacatatttactatatggtgtttacagataaagtttgcagatgaatggaaagaaaacctgatcttcttttttggggcaaacattaacaacattgacatctgattacccatgatactctcaagatcttattctttaacaaaaaggtggggaaataaaaacaccataaaagcggccgggtgcagtggctcacgcctgtaatcccagcactttgggaggccgaggtgggcggatcatgaggtcaggaggtgagaccagcctggccaatatggtgaaaccctgtctctactaaaaatacaaaaattagccgggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatagaaataatgactgaagttgtgagaatagttttaaaacaatctaaattttagaaaggcatatgattccatgaataaatgaataaaaatatgacaaaatagctttagcttataattcaaacatgcttacatatgccaataattttggttatgctatgattcagagcacagttaaacaaacttgtattattgttttagattattgggaccaaaaataggtaactctcttggctccttatcaaattcaagcattagatcacaagttgattctcactatatttgatacccagtcacacactgcataattatgtttcagtcaacgatgaactacagaaatgatggttgtcccataagattataatagaggtaaaaaactcctatcacctagtgacttcgtagccatcctaatggttgtttaaatgcaatgcactacctgcatttgtggtgatgctggtgtaaacaaacccactccactgtcataaaaaagtatagcacatatgttatgtgtagttcataatacttgataatgagaataaatgaccgtgttactgatttatgtatttactatactttttatcgttagagtgtatatcttctgcttattaaaaaaaaaaaaaaaagttacgatacaacagcctcaggcaagtccttcaggaagtattccagaagaaggcattatcatcacaggagatgacagctccacgtgtgttattgcccctgaaggcctttcagtgggacaagatgtggaggtgaaagtgatactgacattctttacccagtaaaagcctagactaatgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaagttttttattttattttatttttttctgagagggagtctcgctcttgctcagactggagggcagtggcgcgatattggctcattgcaccctctgcctcctggtttcaagggattctttttcctcagcctcctgagtagctgagattacaggcgcccgccaccacgcccggctaatttttgtattttagtagaaatgggggtttcaccatgttggtcacgctggtctggaactcctgacctcaaacgatctgcccacctcggcctcccaaagtgctgggattacaggcgtaagccaccgtgcccagcctcaaaaaattttttaaaatgtaagtttataaagtaaaaatgttctttgggaagttgaggtgggaggatcacttaaggccaggagctgaagacaagcctgggaaacatagcaaggccttgtctctgctaaaaactttttaaaaattagctgggcatggtagtgcacacctgcaacctagctactagggaggctgaggcagaaggatcacttgagcccagagtttgagtttatagtgagctataattgcactccagtctatgcaacagagaaagcagctatctctagaataaataaagtaaaaaagttacagtaaactaaggctaatttattattgaagaaacttaaaaataaatttagtgtagcctaactgtacagtgtttataaagtctatagtagtaatgtcctaggccttcacatgcactcaccactcatcatactgactcactcagagcaacttccagtcctacaagctccacttatggtaagtgccctatacaggcgtaccatgttttatcttttataccagatttttactgtaccttttctatatatagatatacaaataccattgtgttacaattccctacagttttcagtacagtagcctgctgtacagggtgtagcctaggaataataggctactacacagcctcagtgtatagtaggctgtaccatctaggtttgtataagttcactctataatgttcacatgacaacaaaattgcctaataacacatttctcagaatgtatctctgtcattaagtgatgcatgactgtacttagattttcatcaaatttttgccacttaactatgggtttgcccattaagtggcatgcagttatatctgggagtgtataggtattatttttattcctgttatgttttttgttaatattctatgaattttaacagacaactttcttaattttcacgacatataaaatgaatacctaaaactgaaatttgatcttatgaagaccaccctcccctactccccaattcttcctttttctagttggcatctcatggatttagcttgtagcattcatccctatacacggtctaattgcaatgtcctccttgatgccattctggtaaaatttaaaggaaaacttcaccagcattaatttttttattcattaaaacaacaaaccttggccaggtgcagtggctcatgcctataatcccagcactttgggaggctgaggtgggctgatcacctgaggtcaggaatttgagagtagcctggccaacatggtaaaaccctgtctctattaaaaatacaaaaaaaattagccaggcatggtggtgcatgcctgtagtcccagctactcaggagggtgaggcaacagaatcgtttgaacccgggaggcggaggttgcagtgagccaaggtcacgccactgcactccagtatgggcaatagagtaagactctgtctcaaacaacaaaaaaaccaaccaatgacaaaccttaaaaaaatagtatcagccaccactgtagccagatataatgaaaaatgtacaaaaacgattcacatttgtgctactgagaatttgttgttctgaaagagcaagtttaaaatgtacataccaaacaaaattccgatttactccagtcacacgaagttagttttaaattttgcactataatatatgtattcagtttaagttcgagaattagaaaacagctcttctagaaaatttaaaaatcaattttacccaatgacaggactaatgagtcttcctaaatgatttaatgaggtctttttaaacaaaatgtctgcatcatattaatgataagcaactagaagaaaaaaagatgtcaaacatgaggacataataatggaaaaatataaaaaagctaaaatttccgttaagtgtaccacatttctacttatgtatggagaatggctattcatctgacagagcaaaatgcagcctccttaccagtcactgttacaacatcatctttacgagcttcagccatttcctgaacatggacttctgagttcacatcaacctctttccctgataactgtaaatgagcttgaagtgaagatgggaccttgacaataatagaacctgtaataaatataatggagagcttagtaatataaagaaatcaaaagtaccagagtctattataaatttgactgacagggtagcattgctcctgagacactgtttttactcctcagcatacagtatttatttaaaccttttccttattcccaggtgcccaaagtttccttactctcggcattcacagtaacttctgtcaagaatatgggttattagcacattattaactactagatctgcttttgccaatagtcctacacagctcatccaacaccagaaagtgagtaatttactacacatgtagcttatagataggatttgccattgagcatttaatatgagccagacccctaattacattatgttttaatccccatattaactttatgaggtattattatcgccccgattttatagataagaacttgctcaagttcccactagtgctcgtgctggaacctagactcagctcaataattacaaagcccatgcttttttttttattattatactttaagttttagggtacatgtgcacaacgtgcaggttagttacatatgtatacatgtgccatgttggtgtgctgcacccattaacttgtcatttaacattaggtatatctcctaatgctatcactccccactgccctgaccccacaacaggccccggtgtgtgatgttccccttcctgtgtccatgtgttctcattgttcaattcccacctatgagtgagaacatgcggtgtttggttttttgtccttgcagtagtttgctgagaatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgccacgataaacatacgtgtgcatgtctttatagcagcatgatttataatcctttgggtatatacccagtaatgggatggctgggtcaaatggtatttctagttcaagatccctgaggaatcgctacactgacttccacaatgtttgaattagcttacagtccacccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatatcctttgtccactttttgatggggctgtttgtttttttcttgtaaatttgtttgagttcattgtagattctggatatgagccctttgtcagatgagtagattgcaaaaaatttctcccattcagtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggtcttcttctagggattttatggttttaggtctaacatttaagtctttaatccatcttgaattaatttttgtataaggtgtaaggaagggatccagtttcaggtttctacatatggctagccagttttcccagcaccatttattaaatagggaatcctttccccattgcttgtttttgtcaggtttgtcaaagatcagatggttgtagatatgcggcgttatttctgagggctctgttctgttccattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaaaaggtccttcacgtcccttgtaagttgaattcctaggtattttattctctttgaagcaattgtaaatgggagttcactcatgatttagctctctgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctctattcctaattgaataccctttatttccttctgctgcctgattgccctggccagaactttcaatactatgttgaagaggtgtggtgagagagggcatccctgtcttgtgccagttttcaaggggaatgcttccagtttttgcctgttcagtatgatattggctgtgggtttgtcgtagatagctcttattattttgagatacgtcccatcaatacctaatttattgagagtttttagcatgaagcgttgttgaattttgtcaaggccttttctgcatctattgagataatcatatggtttttgtcgttggttctgtttatatgctggattatgtttattgatttgcatatgttgaaccagccttgcatcccagggatgaagcccacttgatcatggtggataagcttcttgatgtgctgctggatttggtttgccagtattttattgaggatttttgcatcgatgttcatcaggaatattggtctaaaattctctttttttgtgtgtctctgccaggctttggtatcaggatgatgctggcctcataaaatgagttaggaaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtccagaaatttatccatttcttctagattttcgagtttatttccgtagaggtgtttatagtattctctgatggtagtttgtatttctgtgggatcggtgatgatatcccctttgtcattttttattgcgtctatttgattcttctctcttttcttcttaattaatcttgctagtggtctatcaattttgttgatcttttcaaaaaaccagctcctgcattcattgattttttgaaggtttttttgtgtctctatttccttcagttctgctctgatcttagttatttcttgccttctgctagcttttgaatgtgtttgctcttgcttctctagttcttttaattgtgatgttagggtgtcaattttagatctttcctgcttcctcttgtgggcatttagtgctataaatttccctctacacactgctttgacataccagagcataccagagattctggtatctttgacataccagagattctggtatattgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttcctgaggagtgctttacttccaactaagtggtcaattttggaataagtgcggtgtggtgctgagaagaatgtatattctgttgatttggggtggagagttctgtagatgtctcttaggtctgcttggtgcagagctgagttcaattcctggatatccttgttaactttctgtctcgttgatctgtctaatgctgacagtagggtgttaaagtctcccattattattgtgtgggagtctaagtctctttgtaggtctctaaggacttgctttatgaatctgggtgctcctgtattgggtgcatatatatttacgatagttatctcttcttgttgaattgatccctttaccatattatgtaatggccttctttgtctcttttgatctttgctggtttaaagtctgttttatcagagactaggattgcaacccctgcctttttttgttttctatttgcttggtagatcttcctccatcctttattttgagcctatgtgtgtctctgcacatgagatgggtttcctgaatacagcacactgatgggtcttgagtctttatccaatttgccagtctgtctcttttaattggagcatttagcccatttacatttaaggttaatattgttatgtgtgaatttgatcctgtcattatgatgttagctggttattttgctcattagttgatgcagtttcttcctagcctcgatggtcttcacaatttggcatgtttttgcagtggctggtaccggttgttcctttccatgtttagtgcttccttcaggagctgttttaggggcggcctgttggtgacaaaatctctcagcatttgcttgtctgtaaagtattttatttctccttctcttatgaagcttagtttggctggatatgaaattctgggttgaaaattcttttctttaagaatgttgaatattggcccccactcacttctggcttgtagagtttctgccaatagatcagctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagactggggaagttctcctggataatatcctgcagagtgttttccaacttggttccattctccccatcactttcgggtacaccaatcagatgtagatttggtcttttcacatagtcccatatttcttagaggttttgttcatttctttttattcttttttctctaaacttcttgcttcatttcattcatttcatcttccatcactgataccctttcttccagttgatcgaatcagctactgaggcttgtgcattcgtcacatagttctcatgccttggttttcagctccatcaggtcctttaaggacttctctgcattgattattctagttagccattcatctaattttttttcaaggtttttaacttctttgccatgggttcaaacttcctcctttagctcagagtagtttgattgtctgaagccttcttctctcaactcgtcaaagtcattctccatccagctttgttccgttactggtgaggagccgcgttcctctagaggaggagaggcgctctgattttgagagtttccagtttttctgctctgtttttttccccatctttgtggttttatctacctttggtctttgatgatggtgacgtacagatggggtttttgtgtggatgtcctttctgtttgttagtcttccttctaacagtcaggaccctcagctgcaggtctgttggagtttgctggaggtctactccagaccgtttgcctgggtatcagcagcggaggctgcagaacagcggatattggtgaacagcagatgttgctgcctgatcattagtctggaagttttgtctcagaggagtacctggctgtgtgaggtgtccatctgcctgtactgggggatacctcccagttaggctactcgggggtcagggacccacttgaggcagtctgtccattctcagatgtccagctgtgtgctgggagaaccattactctcttcaagcctgtcagacagggacatttaagtttgcagagctttctgctgccttttgtttggctgtgccctgcccccagatgtggagtctacagaggcaagcaggcctccttgagctgcggtgggctccacccagttcgagcttcatggccactttgtttacctactcaagcctcggcaatggttggcgcccctcccctagcctcgctgctgccttgcagtttgatctcagactgctgtgctagcaatgagcgaggctccgtgggcataggaccctcagagccaggcgtgggatataatctcctggtgtgccgtttgctaagaccattggaaatgagcagtattagggtgggagtgacccgattttccaagtgctgtctgtcaccccctttctttgactaggaaagggtactccctgaccccttgcgcttcccgggtgaggcgatgcctcgcccttcttcggctcacgctcggtgtgctgcgcccactgtcctgcacccactttctgacactccccagtgagatgaacccggtacctcagtgggaaatgcagaaatcacccgtcttctgcgtcgctcacactggcagctgtagactggagctgttcgtattcggccatcttggctccaccccaaagcccatgcttttaaccaccatggtatttcacacactcctacctcatcgtagtacaggacttgtgacctcattattataacacaactagaacactgagctcttgtgctttcagatgtgccttgtgtgtaacaaaaaataacaatagaaaaggattatttgaattccaactcactaatgtttcttttgagtagattacaggcttttggatacctaaggtaagacactcaacctgtatttccatacaacctggctgtaattcaagcttctaaaggagtaaatcaggaaaagtactctgttaggtatggaatcatttttcgaattatgtgggttgcagcgtaaattcaccaacacactcctatttcagaagtttttcttcctgtttttcattaaataaagtaggtaaaaggcccctgccataaagcattaaccccacctctgtggacaaagatagttaggatggggtttagaatgcatttacttatgggtcgtggttttccttccaatctggctaacatcagcttaagcttccttaagtaatttcttggtcttcctaactggagctagaagtttgagataaacatgatgaactgttctattctaaaaaaaattagggaacaatgcatattactagaactagtttattttattaagaaataaattgcagccaggcacagtggcttgtggctgtaatcccagcactttgggaggccaaggtaggtggattgcttgagctcaagggttcgagaccagcctggacaacatggtgaaaccctgtttctacctcccccagctcaaaaaaaaaaaaaaaaaaaaaaagctgggtgtggtggtgcacaactgtagtctcatctacctggaaggctgacctcccaagcttaggcgatcctgatgaggctgcactgagccatgaccttgctgctgcactccagcctgggtgacagagtgataccctgtctcaaaaacaaaaacaaaaaaccaaatttctttccagggttcaaatgtaaactacagacaggagattcccataacaacatatgagggctttaggaaaaaacaaaacaaaaacaaccctggaagatttcaggataaatagaggacacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctggaacgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagttttacagttttctgtttgttttattttgcctactgtgcaaaacattaaattatttgtatgtaacagctgcttattcaaaactttgttcttactctgttactagttatattaacaatatatccttcttctctttggatctttgtgataatggagtacagttatatgacttacatgccatttataattttccctgaagcgtattacctgaagctcttagatttagtgaggacataagtttatcctattttaaagggagaaaatatgatattgagaagtcacaccggtgcatcagcaataactgaggtttcagacctctgtgttttgcagttttgacactgacaaattctagagatggattaaaaaaaactattacatcaatatggtaaagcaactactaatagcaggaacaatcagtctctgtgaggaaatattttccttgttaaacatctggccaacatgcaagagctgctagactatttaaaaaatttttttatacagagctacagttcttaactttctgcagccaagccacttcagcccctatggccaacctacttcacccaagccacttgtcaacacatatgtgtacatccatgtgtgcagaagaacagacaaattcatatttatctttcagatgaaaagtataccattttaaatgaaagagttggactcagaataagttgtgtcagaagttaaatgatagagacatatcataagtcttgatacttcaagagactaagtaatcactttagaggacctttctgtgtgatacctttatttaaggatcacactttgaaaactgttactctacactgattgcctgagaagttccttttacaggctggcagagaagcttccaaaagagtgtatggcagtgtttttccttcaaagattattctatttcagaatagaataaactgaaaaatccacagagtaacatttaaaaattccataataacagtcaaaatattacatttttgtttgtactacaaagggaaagatagtctgcatggccatctatcccaaaagttgtaaagatcactggtctagaaagctagcagaccagtgcctttaaattaggttctatcagaagatattttcttgaaatcactatgtcagtatagataatttgaccatctgtttcctgagtgttacataaaccttccttacatcatatgtcaaaataaaacattccagttcactaacctttatgggatttcaattccactttccccagttggctgacataaacatctatggcaccctgattagttgaggcttttagacatccagaagacgaatctaggaagaagaaaaaaccataagtaaaataactcttacttgataaatggaattacaaacttgaaataaaaggctctgctttagcattaggataaggggctaagaatcttgcaaggtttagtattttcctcataacaatgccattgtttgcacttaaacgtaaacagttatcagaaacctagaaatctattaaacaactaatttaaaaatctttatctatattaacctgaataacttatctctaaacatttactctaaaactttatgagtaggaaggagagtctgcaagtaatggttcctttgaccactaagcatcattgatatatttagttttttatcatgttgatacatttagtaaactttcaataattaccaaagaattctacctcatgtatagtcacatacaagcagtagcaaggctgacaaaaatcaaaacctctcataatttctccttgtagcaaatttgctgatactaagaagtgctcctaatagtaaaagattactctacataaagttgtcgcatttctttttttttttttttttttttttttagagacagggtcttgctatgttgtccaggctggtctctgactcctgggatcaagcgatactcctgggattacaggcacaaacccactgttcctggcttgctgcatttctttaaggggcagaagggcagggtggaataatttgaagaatagcttgtttatatctaatagttcttttcaagtttctggaattgaacaggtatctttaagtgaggataagaaaataataattaagataaccctgatttgtcattcaaatttccctatgtggtcgatgaccccacttttgaatcaaccagtatctcaagttcaagggaaaacagtcaaaataaggaagtaaggaaatgaacttgaagagttagtgctaagtggtttttccttcttctctttctcccatggcaattgaatctttaatttaatattctatctgactgcctggagaaagccaaagcatattctttttagagaggcctcttaaaaagcatattttatcaggaggttttattacttcaaagtggaaacaaagtagggagtgtggtgaaaactatgccaaaaattatactgtttacaaaacagagagagaaaacatttgtgtgtgtgtgtgtgtgtgtgtgtgtgtgtgtgtgtgtgtgtatataggagccaacatttttcttttaaaaaaatgttaactgacttcaaacaaagacagtaaatttggaataaactttaaaatctggctccaagatcatttataataatttatttccaatctatactggaaaatgccctttatcagactcaatttatttagttttcaagtgtcaaaagttaacactgacattgggaaatgaaaacactagagataaatgacacagaataactggacaaaatgaacatttcactgcttacgtaccaacagaaactcctttttaaacctcttaccgcatcctaaaagaagccaagtaaaaattacattatgctaaaaaaaagaaaagcgtaatacacaaggtgtgtattattccagtttgaacaaagtaaaatagctgaaacattagtgtgatttctcgctttctcaaggagggaaaaaaaacacagaatttttatgtggctcataaataatactttcatttatttttccctccaaatgagaaataaatgacagctaaataattatatcctaggccacaaagtaattatatcctcgtgttatctgtattgatctctaatgatggctcatcccttggaggctgttaaaaaataaaaaaatgaaaacgcaagatgttttcaagaaagaaggcaaaggtgatattttaaaactatgcagcaaaacaagccctcctattttttttgtttaacacaaattatcagaactaaaattaattatcaagagtaaaattaaggcttcatccacagaatttcattcttttggagtttacataatggagaaattctatggatctgggagaaagtcctgtagatctaatatatagcacagtgactgtaattaacaatactgtattgtaaacttgatatttgctaagagagtaaatcttaaacattttcatcatacacataaaatggtaatgaggtgaagtgacagatatgttaactaaacggactgtggaaatcattccacagtatatatgtatatcaaatcattatattgcatgtatgccttaaatatatacggttttgtcaattatgtctcaataaagtcagcaaaagccaaaaaaaaaaccacaccacaaaagaaaccaaaataaatctacattgtaacgtgattagctcagtgcttggcacatgggcactgagtaaatgatagatattttaaagaaagggccaggtgtggtggcttatgcctgtaattccagcactttaggaggctgaggtaggagaactgcttgaagccaggcatttgagaccagtatgggtaacaaagtgagaccttgtctctattttttaaaataataaacaagtaaataatgttaaaagaaaaatcagtcagtatagttggtcatattaataaaagaaaaatgatcatttcaataaattcaggaaatgtgtttgacaaaattcaacactcattcacgatcaaagaaagtaaaaaaggagaaacttttaagcaaacaaggaataaaagattactctcccaatctgataaaaggcatctgttaaaaatctatagctaacatcacacttaatgcattccccctaatattggggacaaggatagggatcaagtgcaaggaatcacactctcatcactacattcaacattatactgaagttcatagctagtctgataaggcaagaaaaagaaaagtaataaagataggagggaaagaggtaaaactctatttgcagttgaaaatgtctgctcagctagaaaaggattctagatttgagaaaaccgctattagaataaatttagcaaggtcacaagatacaaggtccatttataaaaatcatttgtatttacatatatcagcagtagacaattagaagcaaagtcttaaaaactgtctcatttataacagtgttaaaaacacaaatgaatttaacaaaaaaatgtgccagacctctacattgaaacttacaaagcaatgctgagaaaaattaaagaagacctaaataaatggagagagctacctaccatgttcattaattggaagatacaatgtgattcagtgcaatcccaaacataatcaaaactgtattttttggtagaaactgactggaaaatcaaaggacctattatatccaaagtaatccttaaaaggaacaaatttggaagacttcaactacctgatttacagacttaccaaagttacagtaatcatgatattgtggcactggcataaggctcaccaaataaatcaatgaattaggaacaagagatcagacattgagccacacttatatagtcatttgattttagacaaggatgctaaagtaatccatcagagaaaggaagttttttcaacaaatgatgatataaaaaaattttaaaactgacaataataaatgttgatgaggatgtggagcaactgaaattctcatacattgttgatgagagtataaagtggaactctgggaaaaggtctggtagtttatcataaagttaaacatagaacctacctagtcaactcagcaatgccatacctaagtatttacccaagaggaaaaatatatatacatccataaaatgacttacattaatatattcatagcagctttatttacagttgccaaaaaattagaaatagcccaggtgtccatcaacagtagaatgaacaaattaagccttctaatagcctgctttcacttctgaacccttctggtacattatgaaataacagctagattgttcttttaaaatataaattatatatcacttccctaacatcctgttgtagttggaataaagtctgaactcttaccctgtctacaaggtcctaagatctagccttacttacctcatatcctaccactttcctcataagccagccttctttcccttgaaaatagtaaacttccattttcaaggcctgcacttgctgttcctctatctagggagcctgtatccagaattttatataactctttctcatttttctggctttggtttaaatgtaccctctccagaccacccccaattgcctaactgaagtagctttctttttccccaatctctattcagttaccctttcttatttcttcattgtacttaccacaaactaaaattaccttttgttatttatatgcttgttgtctttcttcccagggctcagagaaggtgaagtctctgagcacagaaactatgtcctgttgaccaatatgttccctagtacctaaaagaattcttaatacatggcaggtactcaataaatacatgttgactaactagttattggtattcacaaggttgtcttcaaatgttaacacatttggagcccaataaacagtgacattatttatatctttctttcaaggacttaatttagatatttgaagaattcaagaaatttgtaagatctttttttctttcttttttttttcttcagagaagtttagcaagaaatataagacatttcttaataccagctcaggcaattttcttcgagtggacataattagtacattggttctgcctatatttgacttgtgatcctgtcaagttcatcagttaaactgtagaattcatttattctaataaagtcatcacaaatatacccatttttaaaagtggacaaaatacacgaactagtagcttagtacgtacctactgtgatgttacccatctcgctttgtaatgttatattacctgccaaaaagaaaaagatacttttatgtactagagacaatctagaaaggaactgtgatacatagcaatgctaaaacatggatgaatatctacaatgttatttttgttggcaatttttcccaatatcacaagtccagtcaaagattgagctgtagttctgaaataactggcttaggtatctctgcaaaccttctttctctactaccaaaccttaagcttttatagcataactacaaatcaccataactgctggcacagaggaaaaacaatacttctaaaacctgtaagtgaaaaaaattactgaaatgtagtcactgtacattttcaacctaaatatcaatgtatttatcagaccacacaaagcgaagttttcaaccaagtaacactaaaatatggtatggaaaaaaagaattacttttatttttcaggccacttgccatgtctattaaattaaaagtagtttctgggccaagaattaaagtggtttgagataggaataatgaatacatggaggtatgactagcaaaacagaacaaagaagcttcaaagatttccgtcttagtgaaaatatgttttccatgataagtatggaatattgcaaccattcttcccagcccctttcccctaataccaaaagtagtaggattattcttcatatgtgtgtttgtacgtgtaagtattcctagaatcaggaactcatatttattctactgaaaatataagcaataatgttatctcttctaaaataattccaaaactacactaaaaagtaaaggaataactttggcctcagaattaatcttcagtaaactcattttatctcatttcatataccttatgaatactgacttgtatcagtatctgggaaaaaccaaaaaaaggcactggattcatttactcaatagccagatgcgcctaattgcaaaaatccatctgaaggtctaatataccatcatatttcctgtgagtatatgaacaaggagtatatttgtgtatgaataaaaacttggtttgtgtactgaagcttataagattactaattttttttttcatattttagattcaggggatacatgtgcaggtttgttacctgggtatattgtgtgatgttgaagtctggggtacaaatgatcccatcacccaggtactaagcatagtacccaatagtttttcaacccttgccccgtccctccatcccccatctagtagactccagtttctattgttgccatctttatgtccataattatccaatgtttaccccccacttataggtaagaacatgtggtatttgattttctattcctgtgttaattcgcttaggataatggcttccaaccgcatccatgctgctgcaaaggatataatttcattcttctttatggccgcatagtattccatggtgtatatgtaccacattctctttatccagtccaccactgatgggcacataggttgattccatgtctttgctattgtgaatagagcttcagtgaatatgttgagtgcatgtgtctttttggaagaatgatttattttcttttgtgtatatatccagtaatggaattgctgggttgaatggtggttctgttttaagttctttgagaaatcttcaaactgctttccacagtggctgaactaatttacattcccaccaacagtgtatgagtgttcccctttctccacagcctcgccagcgtctgctgtttttttacttatttttaataatagccattctgactggtgtgagatgatatctcattgtggttttgatttgcatttctctgatgactagtgatttggagcagtttttcatgtttgttggtttcttgtacgtcttctcttgagaaatgagcaaaatgtcctgtcttttgctcatttttaatagggttattagttttttgcttattgatttgtttaacttccttgaagattcaaaggaacaaaggatattaaacctttgtcagatacagagtttgcaaatattttctcccattctgtaggttgtctatttactctgttcataatttcttttgcagtgcagaagctctttcatttaattagatcccaatgaggcaagtctaggaggacaggaatcacatctttcttatttagcttcatacctgggaactttgcacagtgcatagtacatagtaaacacaattattttgtgaacaaataaaaagtttggaaaagtaggtaaagagcaacctgtggtagaaccacagagtgctaagtctactgactatcctacaccaaaaaagttagtgaagaatttcaagatggataaaaatacaagaaaaccatgctttaaggagattcacctagtgtgagacagtgggtgtttccattctcagcattctctttactgcttgttgtggtttgaacgttcccacaaaagttcatgtgttggaaacttagtccccagtgcagcaatactgtgaggtgggacctttgggaggtaattgggtcatgagggctctaccctcatgaatggattaacccattcatgaatcaatggattaatgggtcatagagggagtgggttagctattacaagagtgagtctgttataagagccagtgtgggtgtctctcatgcagcctctctccatgtgaggcctgtgccacttcatgactctgcagagcccctatccgcaagaaggctctcaccagatgcggctcctagacctcagacttctcagcctccagaactgtaatatataagctttataaatcactcaatctcaggtattctgttgtagcaacagaaaacagactaagacactgctctacctcctgaacaataaaagatagacaggtccctgatattcgtaactttattaataaagaactatgataaagttttacagtcatttagctagtgaatccagtcacccactcatcaaggcaatggagctttatagttttacactagtctttaataatgcagtaaaaatttacaatttttttaaaataaaaatatggtctttctcaaaaagccaatcattagtgcttgtcatgaaagtgaggaggtcttgagaaaacaatgattctttgaaccagaaaaatagaagttttagatctatacaaaatgaggattagttaattatagtgggacctatagagtctcagataacattcttcttgaatgtttgagttctactgtatactaaaagcataatggagcaacaacaacaaaaacccatggaattaaggaatcgtttcaaatactgtctagttgtaagtaacacttcaaaatatttttgtcaactctaaataaaacagtaaacaaaaacttattttcaactcatatcaaaatatttagaaaatctctaccttaaacagaaatattctaaagtcattagaaaacacaaaatggatttcttgcttcaaatgcatactggaataaagtagtatatttaaaagtataccaagcaacaaaatgggcattattagcaaaattttctatattttgatttcacctacttgatctccaatcactgaaaataataaattaattatttgagaggagtaaatcttagtaaaagcttctttccaataaagcagacaccagatggtctgtaataactatgtgtgcttaccctactctcaagttatataagttttccacaaatcccagtatttgagaaaatagtttttcttagcttataacctttcattctagcatggtcagaggaaaaaaaaatgtaatcaatttaaagataaacattggtttatttttcttcaccaaaagaaatgtgattatggttcaagcacatagaactcttaaaatccaaacagagtaatcaagtatccttaaagattaagtcattttgtggtttttggtgggtaggggtggggaggtggaaagggagacacttgtatttgcaagccacagtgctaaatgctaagaatatagagatgaataaaacataatctttgttcttgaggagtttataattaggcaaggatttatagaaaaccagagatgaggcaagatgctttagctgagtactgaaagattaaaaaagtcaccaagatttttaaaaagctaggaaaagcatttcaggcagaatataaacagtatgatcagtatgatcaaaggctctgatcaagaactcagaggtataaaacaggtaaaaatgtatataggaaaaaagactaattctggaagacaaagcatacagtcagaagagggaagagggaagttgggcacgtcactaaggcagtagaaaacggtccgaataagagaatgacatgttcaatgtgcattactaataaactgctttagctgcagtgaggagaaatggatctgaagaaggcaaggctggaggcaaagttattgctagtatcaaggcaagaggtcaagagggtctaaaacagaggtgtagaaattagcaggaaaaaggtgagatagattgaaaaaatatttaggagataaaacctgcctaaacttggtagttgattagatgcaggagatgagagagaaacaggaagttaagaccactgccagatttatagcatgggaattgggaacatggcaatatcagaaacagcaaataaaaacaaggaaagaggacacattacagatgacgttcagggactggggaagaagggaaaaaagcaagaaatgttgagttcaagatgtctgtgaagatccaaatggctatgtctacctgccagatgggatgtataaattagtcagggctagagacatagatttgaataatcagatttgaaacacccttgtaagggtagttcagactcaaaagtatataagatgccctaggaaaatatgtagagaaagaacaataggacaaggatgaaatcctggagaataccaattatcacagaggtggaaagagaaggaatatagagacatttgtgaaagagcaattataaatatatgatagagactgccagtgtccattaatattggtgtgcctctcttcttccataaaagtactgctaaactacatatctcagcctttgcagttaggtaaagccatttgaaaatattttgtccaaagatctatgggcagaagtaatatatgcacttctaggcctggtttctgaaacttcttccatgatcctctgtgctgtctcatttttcatggaagacttggaagccacaaactgaggaagccaagtctctgaatgtctctaaggagctgcacttaggacagacactgtagtaaatatcaatattttgtgtcagaggtctaaaccctgaaaaacctacatggtttgcaccacaaaaaaaaaaaaagctgtaattcctttctagtatttcatataaaaaagttgtggccaggtgcggtggcttatgcctgtaattccagcactttgggaggctgagccgtgcggatcacctgaggtcaggagtttgagaccaacctggccaacatggtgaaaccctgtctgtactaaaaaatataaaaattagccgggcgtggtagcaggcgccttaatcccagctacttgggaggcagaggcaggagaattgtttgaacctgggtggtggaggttgtagtgagccgagatcaagccatcgcactcaagcctgggggacaagagtgagacttctctcaaaaacaaaacaaaacaaaacaaacaaaacaaagttatatgtgtccagattcgaaattaagcatcaaaatgataatcaaattaaaacttcataatgacctaggctaggaataaatactagaatttcaataaaacattttcatgaatgtcatgaaaag

SEQ ID NO: 185 - DNA, 587126 bp, Homo sapiens
ctgacaccattctcaaagttctaattcttcctcctcttggaaggaggatcagatatccccagtcaagatcttgctgcttgtccgggaggagtagtttgggcctgggaccagagggggacggtagggccacctcattcatggctgtggaaagcagaggcactttggccttggtgagcccctttctctgttaaacctattttacaacatgttggtataaagatgaatatattaatgtatactagaggattttctctcacctaaaggttcatttttttcccttctgattttaaaagaaattaaaaatgtatgtcagctcttatagtgtgggcccagggcactgtgcctaatggtaagttggtccagggtaaaaagggtagtgaggtctctctagaagaccccagtgttggccgggtacagtggctcaggcctgtcatcccagcactttgggaggctgaggcgggaggatcacaaggtcaggagttcgagaccagcctggccaacgtggtgaaaccccctctactaaaaatacaaaaattagctgggcatggtggtgtgcacctacaattccagctaacttgggaggctgaggcaggagaattgcttgaacccggaaggcagaggttgcagtgagccgagatcacgccactgtactccagcctggcgacagagcaagactccgtctcaaaaaatatatataaaaacaaaaccatgagatgccacactacacccattacgatggctatactaaaacaaaaagcagtgttggagaggatgtcgagaaatgggaccctcatccactgctactgggaatgtaaaatgcagccactttggcaaacagaacctcagaaagcagcattagcatatgaccacagttccactcctaggtacattctcaagagaattgaaaatgtgcccacagaagcctgcgcacggatgctcatggcagcattatttacagtagccccacagtggaaaaaaacaaattctgcatccactgatgaatgaaagtgtgatacgttcacaggatggaatattactcaactgtgaaaaggaatgaagcaatcacagtcgaggaggaaccttgaaaaagtaacaaaagccagacacaaaaggtcacatgttgtgtgactgcatcctatgaaatgtccattacgggcaaaaccatggaaacaagaagtagcttagtcgtcactggggacgggagaatggagagttaccgtttaatgggtgtagtgtttcgttttggggaagtaagaaggttctggaattggtgatggttgcacaaccttgttgatatactaaaagctgttgggcgctgtggctcatgcctgtaatctgggcactttgggaggctgaggcaggaggatcccttgagccaggagttcaagaccaggctgggcaacacagtgagaccctgtctctacaagaaatatatttttattatattttttttgagacagagtctcactctgtcatccacgctgtagtgcggtggtgcgatctcagctcactgcaacctccgcctcccgggttcaagtcattctcctgcctcagcctcccgagtacttgggattacaagcacgttccaccacacccggctaatttttgtaattttagtcgagacagggtttcaccatgttcgccaggctggtctcgaactcatgacctcaagtgacctgcccacctcggcctcccaaagtgctgggattaccgccgtaagtcactacacccagcctcaaaaactatatttttaaaaattagcagctgggcgcagtggctcatgcctgtaatcccagcactttgggaggccaaggcaggtagatcgcgaggtcaggcgttcgagaccagcctggccaagttggtgaaacctcatctctactaaaaatacaaaaattagctgggcatggtggtaggtgcctgtagtcccagctactagggaggctgaggcagaagaattgcttgaacccaggaggtggaggttgcagtgagcagagatcacgccattgcactccagcctgggcgacagggtgagactccatgtctcaaaaaaaaaaaaaaatagccaggcacggtggctcacgcctgtaatcccaatactttaggaggccaaggcaggagatttgcttgatcctcccaggagttagagatcagcctgggcaacatagcaagatcctgtttctataaaaaatacatttttaaaaattggccagccgggcgcagtggctcacacctgcaatcccagcgctttgggaggctgaggtgggtggatcacctgaggtcaggagttcgagaccagcctcaccaacgtggagaaaccctatctctactaaaaatacaaaattagacaggtgtggtggcacatgcctgtaatcccagctactcaggaggctgaggcaggagaatcacttgaacccaggaggtggaggttgcggtgagccaagatcgagccattgtactccagcctgggcaacaagagtgaaaactccgtttcaaaaaaaacaaaaaaaaaattggcgggggtgccaggcacggtggcacatgcctgtaatcccagcactttgggaggccaaggcgggtggatcacttgagatcaggaatttgagaccagccaagccaacatggtgaaaccccgtccctactaaaaatacaaaaattagctggccgtggggcacatgcctgtaatcccagctacttgggaggctgaggcaggagaatcgcttgaacccaggaggcggaggttgcagtgagcccagatcacgccactgcactccagcctggacaacaaaggagactccatcttaaaaaaaaattaattaaataaattttaaaaattagccggagcatggtgttgtgtgcctgtggttccagctactgggaaggctgaggtgggaggattaactgaacctgggagtttgaggctccagttagctgtgaactgacctccctgggtgacatatatatatttaagccactgagctgtgaaggttgtgaaggtatgtgagttatgtcttgaaaaatacacacatagtgagcgccaaatcccgggagtagtgtttaagtggcgggcttgtcagctgtcaagggctctgcagccctttctctgaatccaagttcttcttcctgtggacagggaacccaggctgcgaactgggaggatgtggcctcgtggggggcagggccagcgtgctgtgatggggatggggctgggcaggttggggctgcctgctactccccactcctgactctgggtggggacagaaggcagagggaggctcctggcacctggggcacaggaatctcaggcatgtggtcctgagcctgtttccaaaagccagaccctcctccccagggcggagagactgggaggggccccaatccaggctccgggatggcctggctggcatctggggttccagtggcccctctcccttggccctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtacggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcccgggagtagtgctagtggtgggtttgtcagctgtcaagggctctgcaaccctttctctgaatccaagtagttcttcctttggacagggaaccgaggctgcgacctgggaggatgtggcctcctgtggggcagggccggtgcactgcaatggggctggggctggggctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaacccccactcataaggacaaagctgctttctcccctcccacctccatctgttctctcctcctgcagcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtccccggccccggtcctcccctttgcaagcccgggctccttccactgtagagtcagcaacagtgctcacccccgctggggccgggcaaggcccaggaggagcaggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtccggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgaggccctctgcggggctcctggtgccctgggtcctcaggctgctggtgattgagccccctgcccccggctactgctgcccctctgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctcaggggattctcagagcagggccaggccatgggctgctgctcttgacgggcacccccactccacatccatgggagggccccagaggagctgcctggggcttggccctgcccagggtggtcccagcctctgaagctctcccctcctcccccaccacctcccatccccagggtgaagttcctcctgatggacaccaggggctcacccagggctgagaccaagtggtcagaccccatcactctccaccaaggtagcgctgggcaggaggggcgctgcccccagtggactcacgatctctctgggccgcctctgctgagctggccacacccctgctcccacagggctgggggcctggaggccatgtccaagtcgggcccagcccccaacagaacctcatgctgggggagtggggcacccagccagccccctcggcaggggcaccatctcggcccatccgcaagcgtttgccacattgtgggcacagacagcctcccccctcctgtagggagtcagcctgtgtcagcccctgctgggagggaggaagagggtgtggaggaggtcagggtcagggtcggggctggctggggaggcagccagcttgagttctgagcagaccccaaggggcaagcgtgaatgtaccaagcccagaagtttcgagtgccacggcccaggtgtcgggggtgggggtctcctgggagacggcttcagaggtcagggggtgtggggtggaagtcttgtcatctgaaggccttgactgctgggctccagggagcagggcagtggatgagcacgtgggtgggagcagcctagaaggtaggagcagggcggaggctgtggtccaggctggcagagaacagatgctgtgccgtcccgaggaagagggacggggggtgggatcaggggggcgcctggggatatgagacagccagaccttgaagctaggccagcgtgggtggggagggagcgagggaggagatgacagccagccctggggtcgaggggcagcccctctgagcagctggtgtgtgtgcagggaagacccccggatccatcgacacctggccagggcggcgaagtggcagcatgatcgtcattacctccatcctctcttctctggccggcctcctactcttggccttcttggcagcctctaccatgcgcttgtgagtggggacaccccctcgggcccctctcccacccagaacccctctgttgaattggtcccagtgtctggaagccctccaggcatgccatggggtttattttatttttggtagagacagggacttgctatgttgcccaggctggtctggaactgctgggctcaagcgatcctcccgtctcggcctcccaaagtattaggattacaggtgtgagccaccttgccgagccccgtggtttcgagctgggcagcgcccctcccagggcctgtgcagggaactcccaccctgagtatctcgcacctcaggggtcattgatggggccagcagcccctctgaggacaggttcgggaggtcccgcctcactcgggccctgtcttttcagtgtgtcctcagccaaggcccttctcctcccgggcctcacctgctgtctgtggatcctctggtggtttagtaagctgacgccagggtagtcagggtggccacctggagaggtggtcctccaattggttctagaagggaggaaggagggatcagagactgcaggtgaggccgggtgcagtggcacatgcctgtaatcctagcactttgggaggccgaggtgggaggatcactggaggccaaaagttcaagaccagcctgagcaacatggtgaaaccccatctccactaaaaatgcaaaaattgtccgggtgtggtggcaggcacctgtaatcccagctactcgggaggctgaggcaggagaatcgtttgaacccgggtggcgaaggttacagtgagcttagatcacaccaccgcactccagcctgggtgacagagccagactccatctcaaaaaaaaaaaaaaaaaaagaaaagagagagagagagactacacatgagggagctgggagggaggagagcaggccttgacccagcacgtgccccatgtggcagggacatatgtctcttcctcctcctctccccgcccagctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggatacccagtccccacctccatccccacctctgtctcacctgacctcctgcgagggaggctggagactgtgtggacaggccgccctgaccgcaagcttccagaccctgggaggaggcctgcagaggactgtgctttgcctgatgcagggagctgggcccatcctggggcctatgagacctgagccaccctccgtcccccatcccacacatcagtggctgggcggggtgaggattcagaggcatctctactgcccctgggcacagcacctttctgagagtgggactctccatggtcatctgactaccaattctggccaccacctccaaccctcttgtgcatatggatggctctagcccttatccaccccctcaagcatttattaagcatctgctgtatgctacatacagtgttagacttggggcttcaggcatagccggtcctgaccttggggagatgccttctctagacctgagacgaccacgtgtccagatgtgacctgttgctgtcgggggtctatcaggcccttagaccgtcaccccagtaggctctccaggacccaggagcctccatcacctggaaggaccctctgtgcaaaacctcaagcgtccatctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcaggactctaggcctccctccgccaagccagagggatgagcaatcacgcctgagagcccactgcgtgccatgcagtccgcacagccgcagcggttttctagatggagaaactgaggctcagtgacttgcccgctgcactctgtccacggccgctgcacacgcccccttgggctgcgctcccggaccttctaatgtgaccacggctcccggcatgcaggccctgccagcggagggagcccggtggtgacccttggtctgcagccctctttggaggtgaataaatgcggtctggagcccaccctggcctgaatggtgcccctgctgggacaggaaatttatgccgggagcccagggccctgctcagcttctgccccatggggttaccctgagcctgtcccttgattgctgtcccggcttgtactttgaggtgcccccatctcctaggaaaatccacacatgtgtttcagggccaggtatgtggtttaggtagtgctccctcccaagcaagcccttgagcccctcatctctggaggcttctcctccatgctgcctgcacccccaccagccaccagaaccccttcaggtatagacagaaacagattcagtcaaattccttggtgtcccaggtgacgtctggccaggggagccagcccctttaagttacactattgcatggctcacacccggaatcctagcactttgagaggctcaggcagaaggattacttgaccccaggagttccagaccagctggggcaacaacatagtgagactctatctctactaaaaatgaaaaaaaagattagccaggggtggtggtgtgcacctctagtcccagctactcgggaggctgaggcaggaggatcacctgagcccaggagtttaaggctgcagtgagccgtgatcgtgccaccgcactccagcctggacaatagagtgagaccctgtcttgaacgaacaggccaggcgcagtggctcacacctgtaatcccaggactttgggaggctgaggtgggcagatcacttaaggtcaggagttagagaccagcctggccaatgtggcaaaaccctgtctctaccaaaaatacaaaaattagcagggcatggtggtgggggcctggaatcccagctactcgggaggctgaagcaggagaatcacttgaacccagaaggtggaggttgcagtgagccaaggtcttgccactgccctccagtttgggtgacagagcaagactccgtctccaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggattacttgaggtcaggggtttgagagcagcctggccaacatggtgaaaccctgtctctgctaaaaatacaaaaattagcctggtgtggtggtgggtgcctgtaatctcagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaagatagagttaaaagaccacctccctgtcagtgacccttcagcagagactgtctcacgctgttctatccagacccaagacagttggctaggggcccggccccggaggggtatgacagggagaaggagggggccgttggtgtttgctgtgtgaaaagatgaattaatcctcccagggttcaaggaccagctaggagcaggattgccatggctttttttttttttttttaacgtggagtctcactctgttgcccaggctggagtgctgtggcgtgatctctgctcaccacaacctccacttcccaggttaaagtgattctcgagccttggtctcctgagtcgctgggatcacaggtgcctgccaccacacccagctaatttttgtactttcaatagagatggggtttcgccatgttggccacaggcttttgcatgtcctggggcccttctatgtttgttctcactgtctgaatccgtgctgatgccagacgcagcgccagggacttcccattcgagcctgcagctgcccctcccttctgcacagcctctctgagcccactgaggagctgccatcaccctcaggagccacctggaacttgactttggaaacaccctctaaacagatcttggaacctagggtgtaaagactgaatcatagtccaggagtccaggggaggctactggcccccactgagagccaagggggcttcctaggggttctttctttcttttctttttcttttttcttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttcttttcttttcttttcttttgagatcgaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttttgtatttttagtagagacaggatttcaccatgctggccaggctggtcttaaattcctgagttcaacagatcctcccacctcagcctcccaaagtgctgggattacaggtgacagccaccatgcccggccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagatggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatcttaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctaggaggcagaggttgtagtgagccgagatcacaccactgcactccagcctgggcaacacagcgagactccatctgaagaaaaaaaaaaaagaagaagaagaacccaagggagggggcactgcccagcacaggcacagtcccatcaggccctggggagccatgccagggcgttctgcccagcacagtcacacctaaaagggtcctcagccgaaccccatccccttgaataccagctcgtgacggctttgagcagaacatgtcacgggaacggcattgtgcagaactttttattaaatggcatttaaaatattccccaggactgtgtagttggggaaacaccacaaaatccattggccgggaacataatggctcaatggttcgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagagccaccttggtctcccgctgggatgtccgtggctcctctctagctgaactctccatgtccactcctgcccgtcgcccattcccctctcagtatccagagggaccaggttctttgttctttttttttttttaagatagagtctcactctgttgcctaggctggagtgcagtggtgtgatctcggctcactgcaacctccagcttcaggttcaaacgattctcctgcctcagcctcccaggtagctgagactataaatgtgcgccactgtgcctggctaatttttttgtatttttagtagacgggatttcaccatgttgaccaggctggtctcaaactcctgacgtcgggtgatccacctacctcggcctcccaaagtgctgggattacaggtgtgagccactgcacccagccaggaccaggttctaaacctgatcacatcgcacctctgctcccataacattcaggaacttcacactgcaagaacagaatctaggttcagacaggtgtggcggctcacatctgcaatcccagcactttgggaggccaaggcaggcggatcacttgaggtcaggagttcgagaccagcctggccagcatggtgaaacgccatctctactaaaaatacaaaaattagccaggcatggtgatgggcgcctgtaatttcagctacttgggaggctgaggcaggagaattgcttgaacccgggaggcggaggttgcagtgagctgagatcacaccactgcactccagcctggatgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactttaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaacatttctttagtacagaacctgctaaggccatcaaacctattgatcggaagtcagtccatcagatatgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacacctgtaatcccagcactttgggaggccaaggtgggtggatacctgaggtcagcagtttgagaccagcctgtccaaaatggtgaaactctgtctctactaaaaatataaaaattagccagacctggtggcagaagcctgtaatcccagctacttggaaggctgaggcatgagaatggcttgaacccgggaggcagaggttgcagtgagccgagatcgtgccaccgcacaccagcctgggacagagcaagactccgtctcaataaaataaaataaaataggcgtggaatagtggctcacatctataatcccagcactttgggaggtggagcagggctgatcatttgaggtcaggagttcaagaccagcctaaccaacatggtaaaaccctgtctctactaaaaatacaaaaattagccagatgtgatggtgcatggctgtaatctcagctcctcgggcggctgagggaggagaattgcttgaacctcggaggtggaggttgcagtgagccaagatcagatcatgccactgcattccagcctgggtgacaagagcaaaactccatctcaaaaaaaaccaagaaaaaaagaaaataacaaaataaaataaacctaaaaaattattaatccgctgagtaactttatgagatagaacttattatcttcattttacagatgaggaaattaaggaacaggaaatttcctttttttgagattataaagctaataaaataggatccaggaagtctggttccagaagcagttgtcttatgttttttttttttttgagatggagtttcgctcttgttgcccaggctatagtgcaacggcacgatctcggctcaccgcaacctccgcctcccgggttcaagcaattctgcctcagccttacgagcagctgggattacaggcatgcaccaccacacctggctaattttgtatttttagtagagacagggtttctccacgttggtcaggctagtctggaactcctgacctcaggtgatctgctcactttggcctcccaaagtgctaggattacaggcatgaacaaccgcgcctgtccccctttctccttactgggtatgttaaaattatttctttcaaaagaaaaggctggtcaaagtgcaacggtgttaaccactaattgatcacaaccagttacagatttttttgttccttctccactccaactgcttcatttgactagcctatggacaaaaaaaaaaaaagaggaaagaaaaagctaaactatttaatctgggctagtaaatggccagaaagggctttataaaaatgaaatatacaaatatatatatatatttttttagacagagtctcactctgtcacccaggctggagtgcagtggcacagtctcagctcactgcaatctctgcctcccaggttcaagtgattctcgtgcctcagcctcctgaagagctgggactatagcgtgcaccaccactcctggctaatttttgtatttttagtagagatggggttttgccatgttgcccaggctggtctggaactccaggcctcaattgatctgcgcttctcggcctcccaaagtgctggaattacaggcatgagccaccgcaccctgccctacatatacattttaattataatatcttttggattctttaaaaatttaaaaaaaattttttagttctttaaaaaattctttaaaacaattttatttgaagagtaataacaaaacaaatctctatttgtgaataaataaaccttgagatcatttatggttttgcaattcaacctgaaaaatgaaatcaaagcttttatcaaaacaaagcatgtttagtgctctctgtctcactgtcttttagatgccaaaccttagattttatgatgactcctcaaccgtttagatcttggttatctcagagggatcgtcagctttttaagaaagttttgagagaaaagcaagtgaagaaaagcatagtcaatgctcaacatcacgggtctctcactgaacacaccacgcctggtattctctcacagcgatgtcaccatttctacctgccacgcatcggtgaaggttgggactcgactggtgtttgatcacgatgggaaaatcatccagaaaaccccctacccccaccccagagggaccacagtcagcgtgaagcagttattttctacactacctgtgcgccataaggaatttcaaaggaatgttaagaaggtacagtaaattaatcttggttttcaagagtattggttaatgcacatgagcaaaagatttactaaagatgtttattcttcagttgattctcttcccataatctattgagaaatgctttatttgcatttctcgttaaagacttaacattaaagacttaactttagggtgatttacttttttcttttcatcacatagtgtttattaggactgggcaacatagtgagactctgtttctatgaaaaattaaaaaaaaaattgactgggcatggtggcatccacctgtagttccagctacttgggaagctgaagtgggagattcacttgagcccagaaacttgaggctgcagtgagctatgattgcgccactgtatttcagactgggagacagagtaagaccctgtctggaaaaatatatatacatatatatattttatttttattttttatttttatctttttttgagatggagtctcactttggcgccctggctggagtgcagtggcacgatctcgattcactgcaacctccacctcccgagtttaagcgattcacctgcctcagccttctgaatagctgggattacaggtgcgcaccaccacacctggctcatttttgtattttcagcagagacggggtttcaccatgttgtccaggctggccaggctggtctcaaattcctgacctcaggtgatccgcccacctcggcctctcaaagtgctgggattataggcgtgagccaccatgcctgccttatgtacttatattttaatgagactatttctcttggttttctgataaatgagttactggaacccttatgaatctgaatgcaaaagaaacagctaaatgttatgtaattgttgtgtttaaaaaccagattataaaactatctgtattatatgattacggttttataaaaacaaaacaacggcctaaatgtgtatagtataaaggctggaagagtcagcactttcatgttctcagcggttatccttggatgtgagatctcatgcactttttgctctcttctttgtgcctttccattttgtatgtgtattttttacaatctaaaaagttacttaaacatatgcagctaaaaactttttttactcgtaaagcatttgatgctaattttaactgttcttttttagacagagtcttctgactctgtcgcccaggctggagtgcagtggtgtgatcttggctcactgcaacctctacctcctgggttcaagtgattctcctgcctcagtctcccaagtagctgggattataggtatgtgtcaccatgaccagctaatttttgtatttttagtagagatagggtttcaccatgttggccaggctggtcttgcacccctgacctcaagtgatctgcctgcctcagcctcccaaagtgctgggattacaggcatgagccaccacgcgtggccttttttttaaagcttttttgcaagtcagctagcaagaacacaggaagaaatactcaaatctcccttacccagctgggggctatgtcaggttttataagcatagggtaatgagttgtgatttgattggatcttgcaataaagtaatgctgggaggtgtgatctgactggatcctgccatggggtgacagcaaaactcaatctgattggatcctggctcctgtcatggagtgtccagttcttaaatcagtctcagctcttcaggccgagcttttagttcccactccgtggtggcatgcttggttaacctgggcatgcacagggtacatgcccttcaacctgtgggtccatggcaattgaaaaacaactgacaacctcattacataaaagttgaactgagccgggtgcagtgactcacgcctgtaatcccagcactttgggaggccaaggcaggtggaggtcaggacttcaagaccagcctggccaaaatggtaaaaccccgtctctactaaaaatataaatattagccaggtgtggtggtgcacccttataatcccagctatctggaggctgaggcagcagaatcacttgaacctaggaggtggaggttgcagtgagctgagttcataccattgccctccagcctgggtgacaagagtgaaactccatcaaaaaaaaaaaaaagttgaaccagatttggtctgatgcagttacagatctacaaacctcacccccaccctcctgccaacaccttccactcctcattcttgagggattagggatggaggtcatgcttctgcttcgacttcatgctgagcagggcactgagtcccctaaagtgaaaggaatgaaactcttgggcttctgagttcaaatgagttctggggtcacccggagtagcttgaaaggctggtattgttgtaatacaagctgaaggtggaagtgttggagcctggaggacaaacagctcaccatccatttaaataaataggaccaaaaagtaacagaacagtggccacgaggggccccaacagaggaagaaaccaggtgaggtgcggtatagtggactcgactgccttctaaatctcagttgttggccaggtgcagtggctcacgcctgtaattccagcaaaagaaaagccaaggcagggtgatcacgaggtcaggagttcaagaccagcctggcaaacatggtgaagccctgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcagtcagtctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcatgcagccctcccacttcactctctctgtctctcctgctccaacatggccagacgtgcctgcttccccttcgccttctgccgtgattgtcagtttcctgaggcctccccagccatgcttcctgtacagcctgcagaactgtgagtcaattaaacctcttttcttcataaattacccagtttctcatagttctttatagcagtgtgaaaacagactaatggcccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatctcctgcgttttcagtctggcatggaaaagcccccgtgcaactggtaaagatatcaataagcaccaggaggtatctaaatccaccaggagccataggcatcacgttgacgtccatttaccagtcttccctggcaagattcttctgaattgtgctgccttgaccaaaagaggtatgggaggggctgggcgcagtggcttgtgcctgtaatcccaacattttgggaaaccaattcaggtggatcattagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaacaaaagtccgggcgtgatggctcacacctgtaatcccagcactttgggaggccaagacgggtggatcacgaggtcaggagttcaagaccagcctggcctagatggtgaaaccctgtctctactaaaaatgcaaatattagctgggcatggtggcatgcacctgtaatctcagctactcagaagtctgatgcaggagaattgctaaaacccaggagggagaggttacattgagccgagattgcgccactgcactctagcctgggcgacagagcaagactccgtctcgaaagaaagaaagagaaaggaaattccccagggaagtacctcggcttatttcataaacaggtactgaaggaagcagaggcatgtggaggacttccccacctcgtgcagctatttgggccgtggcatctgaaatttcttatttcagagtcacccctttgatgaccttggcagtgaactgcagtcatctgtttaggcctttccatggcccacgtcaatgccggtatttctgtctgttgcacatttgatttccttgttgttggcatttagaaggccccccgtttcccagatcacaccacgggcatggaccgcagagattgcatcttgtgagtctgtagaaacagtcaaggccttgtcctctcttaggtccagagctcaggttaatgcagattttcccggccatctgtgctgaagtccctgtggggaggctcctggctggtttcctgtaggtagacagctacacgtcctgcccttcattggcttctttccatgaagctcctgccatctacaaaacatgtctcccttcttgaaccacatctctgttattgaaactctagaagtcgaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggcgacagagcaagactccgtctcaaaaaaaaaaaaaaaaaaaagagaaagaaagtatcatgcttttctgcattctgtgaattgttttagtgagttattgaacttgagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatccccccacaaaaaaaaaaaaaagacaaaaaacagaattgtgtcacacaggccagatgcagtggctcatgcttataatcccagcaatttgaaaggcaaggtaagaggattgcttgagcttgagtctgaggccgcagtgagctatgaccacaccactgcaccccagtctgggtgacagcgcaagaccccaactccaaaaagaaaaaagaaaaatcacaaagaattgcatggcagagtgcctgtctttcacagctttaactgctgaaggaactttcttttttttttttttttttgagagggggtgaggagacacaatctctgctagtgattctcttgcctcagcctcccaaatagctgggattataggcgtgcaccaccacgcctgcctaatttttgtatttttagtagagacagggtttcaccatgttggccaggctggtctcaaactcctgctgggatcatgggcgtgagccaccactcccggccacctttagagttttcttaccacctggttttcctctctcaatatctttctctcatttcctgccttaaaactctagcttggcatctgggcacagtagctcatgcctgtaatcccagcactttgggaggccgaggtgggtagatcacttgaagtcaggagttcgagaccagcctggccaacatggtgaaaccttgtctctactatttttacaaaagttagtcggacgtacagacgggtgcctgtagtcccagctgcttgggaggctgaggcaggagaatttgtttgaacccagaggtgaaagttggagggagccgaggttgtgccactgcactccagcctgggagacagagcaagactctgtctccaaaacaaacaaacaaaaaaaccctgtagcttgggatcagccttctcttctattgtttttctttaaaaaataaaaattaaaaatagatgtagatgctatgttgctgaggctggcctcaaactcctggcctcaggtgatcctcccgccatgacctccaaaactgcagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccccaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaagcaaaattatacgtatgtgtatataacagttataacacccatcacacagctttatagaaacagcatctattcaaaaataccagtatttccaaaatatttaaaataatatttcaagtaataatattcaaataaataaatatatttaatatttcaataaataaaataatatttaaataattctatacccatgtttttcaaaataaaccaataaattagatagtatatattagacgtgttagtatatatatctgagacatgttaaaaatcacaactgaattctcacaattcagtcacagacctaaacagcaaataaaaatttctatcaccagaattatgtttttttctggtggggaactaccaatagctataaatagaagagattattatggaaatatcatagataaaaagagtgctcacttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacattttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtccgtaagaaacaggacctcaggttccgccccagggaggttggcattcagcaatataaaaagggtggtggtgccgcaggaaagggtggaactggaaacactcctggtttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgactgccattagcattggaataaagttcctgctgaaaatccacatctcccgtgggtccggtgttctggaagtgagagagacaatgtcacacttcaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacgactccaaaactcacttaatacacccaaggtcagccccagtgatctgcttcatagcaaggactttgggtgggtctgcccagggagtagggcaccctcagagaatgtggctttggacttcatcacagctggggccttttgtgtcacttaagatctaaacttgtaaccatgctagatgtgtttctaatgtgacaacatcacaaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcagtcataatgaacctccccaaactcagtatttatgattctttttgaggcagggtctcactctgtcgcccagactggagtgcagtggcaggatcagggctccgtgcagccccgaccttccaggctccagcgatcctcccgcctcagcctcctgagtagttgggagtagagatgcatcccacgtcgcctggctaatttttgtatttttgtggagaggggaatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacagggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcatgcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttgctgctcaggggcaccaccaggagaggcctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacattgggaggccaaagcaggaggatcacttgaggccaggagtttgagacgggcctgggcaacatagcaagaccctcgtctctattaaaaatataagaaatatgccagacgcggtggctcatgcctgtaataccagcactttagaaggctgaagcaggtggattgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctgtctcaataaacaaacaaacaaacaaacaaactgtccaggtgtggtggcacagccctgtagtcggagctaataaagaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggaccctgccttctacaggcatctagtctaatgggactgggagtaatcaaggcagatgacctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaaggagcagtgaagccgagccaggaaataccaagatggcgagccagtgtgcttgtagagattgtagagagggtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcaagtgatgcgagggggacctgaactgtggcctctgtcatgggaacccagaggaggtcgatggcgtttgtggttgatgtgggaaggagagagagagaagaaccagaaacgtctgcttgctggaggaagcggcatgtccgctcctccactccttttcttttccccttaggagcggtttatggttccttttgttttattcttttatttgtacactggcattggagtttgtttttttggctttttttttttttttttttttttttgagaaaaagtctcactctgtcacccaggctggagtgcagtggctcgaccttagcttactgcaacctccacctcctgggttcaaagggttctcttgcctcagcctcccgagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggtgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcaggatggaggggtattcgaaggtcagatgcaaatccgagaagccagaggaagggttttgggtgatgctcccaggatggtgggctccgatgggatctttggagggggtgtgtctaggtcggctggtgtcaggagggtcttttgtgtgccaggcagagaactgtcccgaagagctgagagtagaggggctaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcgagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagtgaggagaagtgtgcctcccggggggaaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttctttatttgatttttatttttatttatttattaatttattttgagacagagtcttgctctgtgggccaggctggaatgcagtggcctgatcttggctcgctgcaacctctgcctcccgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctaggatctcaggcgtgagccactgcacctggcctgaaaccaagctttcttatcccaagttctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccaccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctccccagccttgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctcttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacgcccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccgcccttccttctttttttttttttttttttttttttgagagagcgtctcactctctcacccagaatggaatgcagtggcgctatcttggctcaaagcatcctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagtctcaaagtcctgagttcaagcaatcctcttgcctcagcctcccagcgtgctaggatctcaggcgtgagccactgcacctggcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtcctcccctggtctctggctctctgagtccctccttttttgttttgttttgttttgacacagaatcttgctttgtcacccaggctggagtgtagtggtgcaatctcagctcactgcaacatccatctcctggattccatttatttttctgcctcagcctctcaggtagctgggattacaggtgcctgccataatgcccagctcaattttgtacttttagtagagacagggtttcaccatgttggccaggctggtctcaaactcctggcctcaagtgatccgcctgccttggcctcccaaagttctggggttacaggtgtgagccactgcacccagcctgaatttctccattcttcccacacaccctcctcaggttctccttcctgaccgctgacccttcttttcttttcttttcttttttttttttttttggagtgcagtagcgtgatctcagctcactgcaacctcttcctcccagtctcaagtgattctcctgtctcagcctcctgagtagctgggattacaggtgtgcaccactaccacttgactaatttttatacttttagtagagatggggtttcaccatattggccaggctggccttgaactcctgacctcaggtgatccgcccgcctcagcctcccaaagtgctggggttacaggcgtgagccaccgcacctggcccccttccttcgtcttagtcaatcctatcccacctcttcttccaccagtcccctcacctgatgatcccaacacttcatcatccaccacctcctggagggagtaccccgaggtgctccgctggggactctgctcattctgggggtgaggttgacggctggtcgtgatctttcccttaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcggggactccacatccctctgttccctgtcccagcagaggctgtgtcctctccactcaaagcctgaagcatgttggggtctcttcatctctgtacatgcccatttcagagtccaggctggtgggagaggaaacagagtgggaaagaaaactagggtaagcagaaacgatgaaaccttataagagtgagattatcatgtacaagagtgagattatcacgtacaagagtgagattatcatgtacaagagtgagattatcatgtacaagagtgagattatcatgtacaagagtgagattatcatgtacaagagtgagattatcatgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaaattttttttgataaaaaataaaagagttacatgacattcagagaccatccaaaaaacctgtgggttcccggctgggctcagtggctcatgcctgtaatcccagcactttgggaggccaaagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataaagaacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgcatattcctctctcttccggccaccttgtctagacacactacactgaggccgtgcccatcgtaaatgatgttgatatgttgtcaaaaaattggcaaaccaggcgcggtggctcatgcctgtaatcctaccactttaagaagcagaggcagacagatcaccagaggtcagaagttcgagaccagcctgtccaacatgtttaaatccgtctctagtaaaaatacagaaaaaatgagctgggcgtgggggtgcacatctgtaatcccagctacttaggaggccgaggcaggagaatcgcttgaacctggaaggcagaggttgcagtgagccgagattgcatcactgcactccagcctgggtgacagagcgagacaccatcgcaaaaaaaaaaaaaaaagaaaaaaaaaaaaaaaggctaaacagcccaggtttggtctgatatgttcagaaaaaagcaaaacagtcacctctcaccttttcttttcccgcagtgatgcagttgaatacaacaatggctgtaggtatgctgcagaaatatcattcaagtgaaacagaagggctttcctagccagacacagtggtcactcctgcaatcccaacactttggttggctaaggtaggaggatttcttgcggccaggggttcaaggctgcagtgagctgtgatccaccactgcattcccggctgggcatcagagtgaggcctgtctctaagaaaaaaacccttcactccccaaaaaaagggatttgcaaataccagcctttcagcatgaggatcacatggaggaacattaagatacagatgctgggacccagccctattgattgtaattcaaaaactgaggtggggcctgatttagctccatcattggaatccattccgatttgaaactctctgggttggacagttcaagagagatcctaaagaaagcaaaatcactatggactgaaatgagcagacaaggttttctgagcatggtgaaatatgatctgggcctcgcttgggagggctgtggccaggccttgagtccttggctcagtgggaccttctgaaacagcctccaagctgcacccctgcttcctttgcttttggatgaccccctccagcagctttggtgctgatgggaataagtcgacctgcagcggaagttcagcccaagtctcagcccagcagcctccccaaacctggccagggtctggtcatgctgccgtctctgcggttctctgtggagttgtggtttctgtaccttgaagagaacttccccttctgggacccagaaacccagtgaaccctcaggaaaaaagggaatgaaattactgaagacaactctgtggcagggagagggaaaagaggctctttgtttttgttttttattttttatttttttattttttgagacagagcttcactcttgttgcccagactggattgtaatggctcaatctcggctcactgcaacctctgcctcccatgttcaagcacttctcgtgcctccgcctccagagtagctgggacaataggcacacaccaccacacccagctaattttcgtatttgtggtagagatggggtttcgccatgttgcccaggctggtctcgaactcctggcctcaagtaatccacctgccttggcctcccaaagtgctgggactacagatgtgggccaccgtgcccagccctcactgtatggattttctaaaaaaaaaaagattacatttgtcttacttgccaaaagggaaattaaccttatctcctctcctttttaaagagtatttccttgataaaccttgtaatataaataacttcttttgtgcctttgatatgtacctaaatcttttaaaaaggtaaatgaacttcttgccaacattacaacccaggaatttttttttttttttttttttttttggagacagaatctcgctgtcacccaggctggagtgcaggggtataatctcggctcactgcaacctccacttcccgggttcaagcaattctcccatctcaacctcctgagtagctgagactacaggcgtctgccaccacgcctggctaatttttgtatttttagtagagacagggtttcaccttgttggtctggctggtcttgaactcctgacctcaggtgatccaccagcctcggcctcccaatgtgctgggattatgggcgtgagccaccgtgcctggtcacaatccaggaatttttttcttaagagcctaagagtcttgtctttgaaatgtaaacctggaggaaaatagtgtccctatcttcctgttgcctagggagtttagcctaggcaacttgagctgttactacctgcttgtcaaggagatgtgagaagttttattttttcattgaatacaggtaattaactagcatggatggccacgttgatttccaggtgaatttaggatgagtgtttaagaatgcatagcaggccaggcgcggtggctcacacctgcaatcccagcactctgggggaggccgagacgggcggatcacttgaagccacacagaaatcgaaagaaggagtttgagtccagcctggccagtatggcgaaactctgtctctactaaaatacaaatattagctgggcatgatggcacatgtctgtaattccagctacttgggaggcttaggcacgagaatcacttgaacccaggaggtggaggttacagtgagccaagaagatcacaccactacactccagcctggatgacagaatgagaccctgtctcaaaaaaaacaaaacaaaaaaaactgcatagcaagtccttttgcatgaggatgagttactatttatcttgagagcgtgtatgcaatggattgtatctgccagactatataaaaaggacgctttggccgggcgccatagctcacgcctataatcccagcactttgggaggcctaggcgggcgaattacgaggtcaggatttcgagaccatcctagctaacataacgaaaccccatctctactaaaaatacaaaaaattagccaggtgtggtggctcgcgcctgtagtctcagttacttgggaggctgaggcaggagaatcgcttaaactggggaggcagaggttgcagtgagccgagatcgcaccactgcactccagcctgggcgacagagcaagattttgtctcaaaaaaaaaaaaaaaaaaggagggtttatttctctttgcatctcattaatggatcacctgtgatgggcatcacagtctggtttaatgcttattcaataataaaattgttttctttattttctgaatttgtggagagaatattctaggttaacagaataatctatttatttacttatttatcttgagatggagtcttgctctgtctcccaggctggagtgcagtggcctgatctcggctcactgcaatctctgtctcccaggttcaagtgattcccctgcctcagcctcccaagtaactgagactacaggcgcgagccaccacacctggctaattttttgtgttttagtagagacggggtttcaccatgttggccaggatggtcttgatttcctgacctcatgatccgccggcctcggcctcccaaagtgctgggattacaggcgtgagccactgcacctggcctcagaagaatttatttttagtcttttccttaccagtttttatgaaacaactgggcaagaacactgttagatttcaccaaaaaattgtgatgaatcattgtctttatgatcccatttttgaaaattgacattttaattgtaaaccaaaaataaaattctaagcccccacaactgactcagtggactcccctgttggccaacaggatccaaaataaacatggaaaactaatttaggtcatgatgggaaggagggggttggacatgccttgtcataattctcctcccgtcagagtttaggcacagctgaccaacattatgatctctattagaatagagatcataggactgacaaaacaggctctttttatcagtaagatacccatctccaaccagactctgatatagcatcacatgacagatagcagtccctgaagtaaattacagtattttaccccaaaacatattttctttgacaaactttaaaatagtcctgcaaagccatctctttgggggaaatttgcattctgtagagaatctctttcccttacagaaaagactccaggtcttttctggagagtctgacaccttttaagatccaataagagatatttatcatctattctccctgaagcctgttctgaggcttcacctacataacaagaaccttggtttccacaatcccccttatcctaactcaaacttttctttcttttttttccctccctctttttccttccttcctctctctctttttctctctctctctttattttcttctctgttgcccaagctggaatgcagtggtgccatcatggctcactgtagcctcaacttcccaggctcaagcgatccttccatctcggcctcctgagtagctgagtctacaggcatgcaccaccacacctggataattattttttttttgtagaagtgggggtctcgctgtgttgcccaggctgtccttgaactcctggcctcaagggatcctcccagctcaccctcccaaaatgctgggattacaggcatgagccaccacaatggcccatttctttatgtagtcttccagctgttcagccaacacttaactctgaaccaactgccaatctttcaatctactagtgacctgaaagcctttcctggctgacccaacatatacttcccatgtattgatttatgtctttgcctgtaactactgtctccctaagatgcataaaaccaagctgtaacccaaccactttgggctcacgttctcaggaccccctgaggctgtgtcaccagccatggtcactcaaataggaggcccagaataaaactctttacagactttgactctttttggtcaacataacctaaccctaaacataatcctcctggggaaggtaagatcacaggtatctcttcttcgttcagtttgtatgtgtatgtccttatttctctacagtttttaggcattcgctgtgtgatctagaaaagctatggagtctcgctttgtcgccaggatggagtgcagtggcgtgatctcggctcactgcaacctccacctcccaggttcaagtgcttctcctgccttagcctcccgagtagctgggattacaggcacgcgccaccacgcccagctaatttttgtatttttagtagagacagggtttcatcatgttggccacgatgatctctatctcttgacctcgcgatctgcccgccttggcctcccaaagtgctgggattacaggcttgagccaccgcgcccagctacaaattctattttctttttgttccttggaaagcatcgctgggcatttatcctgtcccagtatttgagtgaaacttctcagcatttcagagcagtgaccatgatacaccctttcctttccttctccttatggcaaactcggttctaacccagaggacttgggctccaggacccagtaacgcagccctggacttgaccctaaaagggagtaaagacaaaggtgaagttcagtccggggttcagggctgccaaagctcatagcctggagcttcttaacctttaggcggggtagagacatttaagacagcccctaaacttggggagcgcgtaggctcatgggaaatagagtctgttacttgtcctgggaccgcggtgggtgtccggggaggcggacttccggtgcactcctgcgcgtgtgcacctctccctgcgtgcgtgttcgcgcgtgcgtgctcgcacatgcgcgccacctccgcactgccctcgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtgagccccagggaggcggatctgggccccgagaaggacacccacctggatttgccccataggcccggcccgggcccctcgggagcagaacagccttggtgaggtggacaggaggggacctcgtgagcagacgcgtgcgccagcgacagcagcccgccccggcctctcaggagccgtggggcagaggctgcggagccccaggagggtaagtcttgggtttttgggcccggagcgagaagggcctgggtgaagtcaccgtgttttggggaccttagagtgtggggcagagggagggtcccgattgcttgctggagagacatgtgttgggttcgagggcagggtccggctgcaccgaacaggcgctgcatgggaagatctgggaggacgaggcttagggaggcgtggagggtgtcaccaccctcagctgcggacgtcgtctccactccccgctaacccctaacagtccttcctcctcctctccgtgctccagatttcgaccgcctctaaatgtccgtcagcacttctattctctcacttaagtgtctgctgatcccccccttagatctgccctgggagaatcgtagtaatgcaggaacagtctgcagggattctctcctgctgcctcagttgctaggggaagagactgggccttagcaggtgggtgacttgaccaggtcaccggctttgtgggtagagctgctcatagtagaacccaggagacttatctcccaggccagtgttatttctcccgtatcctagttttcttaatagaagattattaggtgccacaataactaagttcagttagataatttagaaacaaaaccatattttatacacattcatttcatttctgagagctcacctactcaattcctatggcctattttattttaggcagtttaaagagacaataagaaaatgcgggcgggatgcagtggctcacacctgtaatccgagcactttgcggggctagggcaagagtatcccttgagaccaggagttagagaccagcctagacaacatggggacaccctgactacaaaaaatacaaaagtcgccaggcatgctgggatgcatctgtggtcccagctactcaggaggctgaagtgggaggatggatggagcccaggaggtcgaggctgcagagagccgtgaatgcaccactgcactccagcctgggtggcagattgagaccctgtctcaaccaacaaaccacaaaaaacatgagccgtataatgggaattttttttctttttgcaccttgtatttgatgatggcagactatttgtaaaaggagtcgtgttacccatgagagtctaactcatctaattactacctgattatcttagagttacaggcgcatgcttcccctatcactttttttttttttttttttttgagacagtgtctctcacccagtctggaatgcaacagcgtggtctcggctcactgcaacttccacctcccaggttcaaaggattctcgtgcctcagcctcctgagtagctgggactacaggcatgtgacactatgcctggctaattttttttgttatttttaagtagagacggggttttgccatgttggcccaggcaggcggatcacttgaggccagaatttgagaccagcctggccaacatggcgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcaagtttccaagagcagcagaaaatgaacacattgcaggtgagttttcctgcttgtgtatatgttcctcaattttattttatgatgcattttaagaggtttgtaaggattcatacttttttttttcttttttttgagatggagtcttgctctgttgcccaggctgcagtgcagtggcatgatctcgcttcactgcaacctccacctcctgggttcaagtgattctcctgcctcagcctcctgagtagcagggattacaggcgtgcgccaccatgcccagctaattttttgtatttttagaagagatggggtttcactatgttggccaggctggtctcaaactcctgacctcaggtgatcttcccacctcagcctcccaaagtgctgggattacaggcatgagccaccaagcccagccaggattcatactttaaaatgggaatgtggaaatagacattatcctgtaaaatatagttagtgtggcagatcagcaccaaaaatgatttgtgaagcttgtatgtatgggtagtatattttaaggctgttgaaattgagccgcacctaggactgatattcttggcagtcatcacaaaaggaaagtgccatctgtattagtccattctcacactgctatagagaaataaccaagactgggtaatttataaagtaaagaggtttaattggctcacgtctgcaggctctatcataggaagcatggctgaggaggcctcaggaaacttacagtcaggtgaaaggtgaagggaaagcgggcgcatcttccatcaccagagcaggaggaagagggaacactggggattacaattgaacatgagatttgggaggcaacacacaccgaaaccatatcaccatccatgacatcgtttgcattgattataaggagaaaccagttttgttacttgtggatttaaaagattttctgggacttggaaaaatttcttcattcaagttggtgtaattgtggatagctttcctaacaacaaccattaattactgtaacttatggcttattcttggtgcttatgtaagcagagggcctgctgcccaaggagaacttggtgcatataatttttccagggacggaaatatcgtgatccaagtaaacaattctgtttttactgttgagtcctagatcatggggggaatgaatgacgtgatcatccgtcaaatatttgttcgtctttttgttcgggttgcacagcaaacaatacagacagttactctcttgtgaagatttcctcatttctgtttctcatttcacttctcagtgttttcgttttgtcctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgaaatttaactcatctttcttatgtgactctaaaggtcaaaccataccacctgaatatttttatcctctctgaatatttccattaaagagtttatttaaaagaatttttaaatcttctcattatgtcttaacagcatgatatcatactctactttttgacttctccatttgatatggaataaaattgcatcatatggccaaggcatatacacttaaagtcttcaatttagaagctttccagagtcaaactgagtcaatctctgctttagaagtctcccacaaaaaggatcctacataaattactgtgtgtttaaaggtttctgattttaatctaataactgaaatatcaaactatattttaattcaggcatttgggcatcactaccacgtgttctcatcagatttaggaaccctgcagcaagatttatcagtgtcaaaatgctaaaatcctaaatttagtgccagaatccctctcaaatggcatttatattttgatagcttaacctactttgaatcccctgagcatcttgtctgtttttattagtagattttgctgatcttttttaacttttcaaaggctctttaaattatcctaaagtcatatatttaccatgagaaagcaggtgtctttttagagtgtagatgcttaagtcgctcataaaattaatttcctcgggttaggagaacattttgaaactctaatttgaaaaactctaatctggcttctaaaaacactgtatcagtattcagaaataataaaaatggaaacataacaacataataaatttaatttaacctagcatagcaaaagagtagggcatttttgcataatcagctagatagttttcagaggcaaacacagagcagtggagactttgtttggagacagccattgtttcaagaaatgggtgttgccttgatgaagctacccttgcttgtcactgcagatccgtctcctgctatcaccagctctgtgtaacattgcctatgctgtggacacacagagatacttgacagtcagtggatgaactcaataaatgttattatttttaaatacacagcttactaaacagataaataatcttaaaattgagactgttccagaaaccagaatgcattttcttcatactcatagcttttgtggtttacatacatttatataattagaatgcaataaaatacattaaacagtaaaataatactctatataatttaatctctggggatccagaaggcactttaagctattacagtttctcagagtcaatgttatgtactttataattttttattctactggtaaaacatggtgatattgattaacagatattttagtagatataatattttataaactgattttattatgtcttgttaatattgggataatcagaatatagagagacttctatacatacacatatattctatatcttcatagctagacttgaagtatctcactttgatgtttctaaaaataaagtgagcacttttgttctttttaatattttatttatttatgtatttatttatttatttttgagacgcagtcttgctctgtcaaccaggctggaatgcagtggtgcgatctcggctcactgcaaactctgccttcctggttcaagcgattctcctgcctcagcctcctgagtagctgggattacaggctactaccaccacgcctggttaattttattttgtgtgtgtatttttagtagagacagggtttcaccatgttgcccagtctggtctcgaactcctgacctcaggtgatctgcccaccttggcctcccaaagtgctgggattacaggcatgagccactatgcccagcccactttgtccttcaatttcttccttcttcttcattttgacccccagtttacatcattaagtacatagtctcgaaacctcaaagtatcagtgttatccttatttttttttctccttctctgaatttgcctgatagtcaaaacctgtgcctactaccacttaaaggttttttttttcatctgtctgactagattgtccactgtctcaccaaatcttgctttgactagtaataatggcagttgagagtactgcctatcacttgaccagactagctaaatgctgaacattcattataatatttaaatctttaaaccaaccttgatttttattttgatttatgagatgactctaccaaaggttagattctgattttggagagctagatcataatagagtcagaattctgttcttaacttctacactgtactccaacaacagtcaaactgttactttctcattcagggtaaaatcctgaccaaacccattactgaaaaccttccttttttatctcagctcccagtctccaccccatgtatctgatacacctgtgacaatgatcttttctccatatctagaaaatatcaccaacttacagtgccgtgttatggtataggctcttatttccacttcctttcatcacagttctatttatttctcaatacacagttgaagatcagttgaaatatcaatttcagcataacttcccatacttgggcataatttaatagcttaccagacagtagcatataatgtagtgacttgggagccagacttcctgggtttgaatacgggatgaaaattcaccagtcttttgaccttgggaaagttactaaaccttcctatacaccagtttcctcatccgtgaaatgaggcaaattatagcacctacctcttagggttgttataaaccttaaatcagttagtacaagtaaaggccttagaacagcacctggcacattgtaagaaatgtctaaaggttcattgctatcatttattcatttccacatctcattcctaaaataaaaggtgttataaaattgccagtataattagaaaaaaaatgggaaaatgtgttaaagaaaaattataaacaaaattgaagaaaatgtagaataatacatatatatcttaggaggaaagctcttaagcatatagaaaattaagaaactatgaaacaagattaacatagttgactatacacaaactttaattgctaatacaggcatactttgttttatgctttgctttattgcacttcacagaatttttttagaaattgaagttttgtggcaagcttgcatcaagcaagtccatcagcaccattttcccaaaagcctgtgctcactttctgtctctgtgtcatatttggtaattctcacagtatttcaaacttttaaattattattatatctgttatggtgttctgtggtcagtgattttccatgttactatggtaattgctttgaggcatcacaactcatgcccatataagatggcaaacttaattgataaatgtgtatgttctgactactccaaagactggccattccccatcttccttcccctcctcaggccaccctactgcctaagacacaacaatatggaaactaggtcaattaataatcctccatggccctctaaatgttcaagtgaaaagactaatgaagaaggcatgttgaaagttgagataggctaaaagctaggcctcttgtgccaaacatttagcaaagatatgaatgcagagaaaaaattcttgaaggaaattaaaagtgctactccaatgaacacatcaatgataaggaagcaaaacaggcttattcatgatatggagaaagttttagtgatccggatagaataccaagccagccacaacattctcctaagccaaagcctaatccagagcaaagccctaactgtcttcaattctgtgaaggttgagagaggtgaggaagcttcggaagaaaagtttgaagctagcagtggttggctcataaggtttaagaaaagaagctgtatctgtaatataaaagtgcaaggtgaaacagcaagtgctagtgtagaagcaggagtgagttatccagaagatctagctaagataactgatgaagatggctacattaagcaacagattttcaatgtagacaaaacaacctatattgaaagaagatatcatctaggactttcatagtaagagagaagtcaatgtctggtttcaaagcttcagaggacaggctgatgtgattcttaggggctaatgcagctagtaacttctaattgaagccaatacttatttgccattccaaaatccctatgacccttaagaattgtgcaaaatctactctgcctatgctttataaatggaatgacaaagcctagatgatagcacggtatacaaatattttaggcccagtgttaagacctactgctcagaaaaaagatttctttcaaaatattattgcacattgacaataacttaatcacccaagagctctgacggagaggtacagggagattaatgttttcatgcctgctaataaaacatcaattgtgcagcccatggatcaaagagtaatttttactttcaagtcttattatttaagaaatatatttcataatgctatatttgccatagatagtgatttccccaatggatctgggcaaggtacattgaaagccttctggaaagggtttaccattctagaagtcattaagaacatttgtgattcatgagaacaggtcaaaaatcaacattaacagaaatctggaagaagttaattccaaccctcatagattactttgaggggttttagatttcagtggagaaagtccctgcagatgttgtggaaatagcaggagaactagaattagaagtaaagcctgcctgggaggggaaggacacgcaccggagcctgttaggggatgggaagtaataggagggagagtattaggaccaatacctaatgcatgcggggcttaaaacctagatgacaggttaataggtgcaggaaaccatcatggcacatgtatacttatgtaaacaatcccacactttctgcgcatgtatccaggaacttaaagtaaaattaaaacaaacaaaaaaagaagtaaagcctgaagatgtgactgaatcactacagtctcatgataaaactttagcaaataaggagttgcttcttatggatgagcaaagaaataagtttattgaaatggaatctattcctggtgaagatgctgtgaacattattgaaatgataacaaaattctagaatatttgataaactttatcagcagcatcagaatttgaaaaatttgacttgaattttgaaagaggttctactgtaggtaaaatgctatcaaacagcatcacatgctatggagaaatctttcatgaaaggaagagtcagtagatgtggcagacttcattgttgtcttattttagaaattgccacagccaccccatccttcagcaaccaccaccttgatcagtcagtagctatcattgtcaaggcaaggtcctccatcagcaaacagattaagactggcttgaaagcgaaagtgatcattaacatttcttaataaaacattttcattaaggtatgcattttattttttagaaataatactattacataattaatagactatagtatagcataaacataacttttatatgcactggaaaaccaaaagaatcatgtgacctgctttattgtgatatttgctctattgcagtgatctggatccaaatttgcagcttctgcaaggtatgcctgtgtagggaaaggcagcacaaactaaactacaatagaagcgacagagcacagagcaaaagagtatacttttaacatatgtgttaaataaatgtttaatacacacatcaaatacagaacctctagaagtcaatataatttaaaatgcaaacacataaaataataagcaaaactctaaatattcaacataaatgatataaaaatgtcctataaacctttaaaaatacttatttaaataacctgcaataactttgccccttaaatagggtaaatttatatagatcagcactaatttaattttggcatgtatttgaagaaatgataaatattacacattgtttatgatggtataaattgcaatattattaaaaggatacatggaatctattaaaatttttggaagtggatatatcttttgattgatttgattgatacagcagttcgtcttttgtgtgtcttatacacacatatacataatatacacttaggcaaacacatttcagacatttggattgggatcctggctgctgcttcaacctcatctaatttcctattacacctcctctctctccctttttgtacatttgtccctctctctgatttccaccatctgtctttccagtttactttctctagttccagacaacaaaaattctttaatcccactgggatctccaatcaattgattcaatcaacttttcattatgcctcaaccctttgatcttctaatctaacttctcataactcaagataaattccatgggaaatccttaacaatcacttccacatatacatccttaactgcctgcctccctcttattgcttttacttgtttggaaaaaccacaacttggttaaatccagatcaccattctctatgtctataattctgcagctaaacataggtagagatcaatacacaaccatcatttctcatcttaaattcataaccacaaacctcatagagatctgttaatgctagtcaggcaattacactgtttcccattcctttaattccttcactatcctgtttcaatttcacacctttttctgctttcttatatgtaaaacacctcctccctgtccttactttcaagtgatcactgtacatcttatttcatgaagaatattcaaatgattaaaagaaaacatcacagattcccatcaccacgtctgcccccacaccgtttacaaacccacactccctgctgcccatcttgttgccccgggtgaactatctgaactactatctaaagtcagtttcttcccacgtgcactacattccagcagcttttacttagcaaagaacattttccagcaatttccttatctctccttaacaccattttctccccttttcctactggatcattctcatcagcatgtaaacaagttattacttgtttcccaacctgaccacatttttcatcttccgtctccgtaaatctgatctgtgccccactatttatttcctgaatttctatgatggccttttacctgatcttcctgcatgtgtcctctcaccctacacaatctattcccagcatggcagtcagaaacaaccttttaaaacagaagccaggtcttgcgcctcctattctgaaatcctcactggtttccccccaccccacccctcatgtcactcagagtaaaccctaacttcgcatgtgcctgacagggtcttacataacctacccgcccccacagcccagacctctctgatcttctggaccattgttgtcctcattgatcactctgctccagctacaactgtctacggctctccctccaccttcccaactgaaggcttttgtgcttgttgtttctatcctgaaaatgaacttctataatgtggttaactttcccttatctcattcaagtatttgctcaagtctttttcagtaagacaggccctaatcatcttatttaaaactggaacctacactcccactccctacacttctgcacccatttactttgctctgctttttcttttttcatagaatgtgtcacattataatactatatagttcactttttactatttatcattttattacctatcccagtcattacattttgagattcaggagtacaaaaatctttgactcttttgttcactgatgaaatcacacacacacaaaaaaaccataaactataacctataaaaaacctataaactataaaataacctatagaaaaacatatgatcacaaaaaaacctataacctatcagcaagaaaattggcatcaattaatacttgctaagtgaattaatgtatttgtgcaaaatatatatacagaagcatgtctggtgtatccttgttttattttttatttttttatttttttcaattttaactattattaacgaacatttatacatttatatgcttttctattttctacactattataaataactgtgatgaatatctttgtaagtctttgatgatacatgtgatgatttccttaggacagattcttagaagtggaattcctggatgcaagaacatgatttttctttttctttctttctttctttttttttaattttatttttattatttttttattttattattattatactttaagttttagggtacatgtgcacaatgtgcaggtttgttacatatgtatagatgtgctatgttggtgtgctgcacccattaactcgtcatttagcattaggtatatctcctaatgctatccctccccccttcccctaccccacaacagtccccgacgtgtgatgttccccttcctgtgtccatgtgttctcattgttcaattcccatctatgagtgagaacatgtggtgtttggttttttgtccttgcagtagtttgctgagaatgatggtttccagtttcatccatgtccctacaaaggacatgaactcatcattttttatggctgcatagtattccatggtgtgtatgtgccacattttcttaatccagtctattgttgttggacatttgggttggttccaagtctttgctatagtgaatagtgccgcaataaacacctgtgtatgtgtctttatagcagcatgatttatagtcctttgggtatatacccagtaatgggatggctgggtcaaatggtatttctagttctagatcgctgaggaatcgccacactgacttctacaatggttgaactagtttacagtcccaccaacagtgtaaaagtgttcctatttctccacatcctctccagcacctgttttttactgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttctcccactgtttgatggggtggtttgtctttttcttctaaatttgtttgagttcattgtagattctggatattagccctttgtcagatgagtaggttgtaaaaattttctcccagtttataggttgcctgttcactctgatggtagtttcttgtgctgtgcagaagctctttagtttaattagatcccatttgttgattttggcttttgttaccattgcttttggtgttttagacatgaagtccttgcccatgcctatgtcctgaatggtattgcctaggttaccttctagggtttttatggttttaggtctaacatgtaagtctttaatccgtcttcaattgattttcgtataaggtgttaggaaaggatccagtttcagctttctacatatggctagccagttttcccagcaccatttattaaatagggaatcctttcccattgcttgtttttgtcaggtttttcaaagatcagatggttgtagatatgcggcattatttctgagggctctgttctgttccattgatcaatatctctgttttggtaccagtaccatgctgttttggttactgtagccttgtagtatagtttgaagtcaggtagcgtgatgcctccggctttgttcttttggcttaggattgacttggtgatgcgggctcttttggctccatatgaactttaaagtagttttttccaattctgtgaagaaagtcataggtagcttgatggggatggcattgaatctataaattaccttgggcagtatggccattttcacgatattaattcttcctacccatgagcatggaattttcttccatttgtttgtatcctcttttatttccttgagcagtggtttgtagttctccttgaagaggtccttcacatcccttgtaagctggattcctaggtattttattctttttgaagcaattgtgaatgggagttcactcatgatttgactctctgtttgtctgttattggtgtataagaatgcttgtgatttttgcacattgattttgtatcctgagactttgctgaagttgcttatcagcttaaggagattttgggctgagacgatggggtctgctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagacacgtcccatcaatacctaatttattgagagtttttagcatgaagggttgttgaattttgtcaaaggccttttctgcatctattgagaaaatcatgtggtttttgtctttggttctgtttatatgttagattacatttattgatttgcatatgttgaatcagcctttcatcccagggatgaagcccacttgttcatggtggataagctttttgatgtgctgctggatttggtttgccagtattttattgaggatttttgcatcaatgttcatcaaggatattggtctaaaattctcttttttggttgtgtccctgccaggctttggtatcaggatgatgctggcctcataaaatgagttagggaggattccctctttttctattgattggaatagtttcagaaggaatggtaccatctcctccttgtacctctggtagaattcagctgtgaatccatctggtcctggacctttttttggttggtaagccattgattattgccacaatttcagagcctgttattggtctattcagagattcaacttcttcctggtttagtcttgggaaggtgtttgtgttgaggagtttatccatttcttctagattttctagtttatttgcgtagaggtgtttgtagtattctctgatgattgtttgtatttctgtgggattggtggtgatatcctctttatcattttttattgcgtctatttgattcttctctcttttcttcattactcttgctagcggtctatcagttttgttgatcttttaaaaaaaccagctcctagattcattaatttttgaagggttttttgtgtctctatttccttcagttctgctctgattttagttatttcttgccttctgctagctttcgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttttgtctttgttctcgttggtttcaaagaacatctttatttctgccttcattttgttatgtacccagtagtcacttaggagcaggttgttcagtttccatgtagttgagcagttttgagtgagtttcttaatcctgagttctagtttgattgcactgtggtctgagagacagtttgttataatttctgttcttttacatttgctgaggagtgctttatttccaaatatgtggtcaattttggaataggtgtggtgtgctgaaaaaaatgtatatcctctttatttggggtggagagttctgtagatgtttattaggtccacttggtgcagagctgagttcaattcctgggtatccttgttgactttcagtctcgttgatctgtctaatgttgacagtggggtgttaaagtctcccattattattttgtgggagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactaggattgcaacccctgcctttttttgttgtccatttgcttggtagatcttcctccatccttttattttgagcctatgtgtgtctctgcacgtgagatgggtttcctgaatacagcacactgatgggtcttgactctttatccaatttgccagtctgtatcttttaattggagcatttagcccatttacatttaaagttaatattgttatatgtgaatctgatcctgtcattatgatgttagctggttattttgctcgttagttgatgcagtttcttcctagccttgatggtctttacattttggcatgtttttgcagtggctggtatcgtttgttcctttccatgtttagtgcttccttcaggagctcttttagggcaggcctggtggtgacaaaatctctcagcatttgcttgtctgtaaagtattttatttctccttcacttatgaagcttagtttggctggatatgagattctgggttgaaaattcttttctttaaggatgttgaatattgatccccactctcttctggcttgtagagtttctgccgagagatccgctgttagtctgatgggcttccctttgtgggtaacccgacctttctctctggctgcccttaacattttttccttcatttcaactttggtgaatctgataattacgtgtcttggagttgctcttctcgaggagtatctttgtggtgttctctgtatttcctgaatctgagtgttggcctgccttgccagattgggaaagttctcctggataatatcctgcagagtgttttccaacttggttccattctccccgtcactttcaggtacaccaatcagatgtagatttggtcttttcacatagtcccatatttcttggaggctttgtccgtttctttttattcttatttctctaaacttcccttctcgcttcatttcattcatttcgtcttccatcgctgatacccattcttccagttgatcgcattggctcttgaggcttctgcattattcacgtagttctcgagccttggcttttagctccatcaagtcctttaaggacttctctgcattggttattctagttatccattcatctaattttttttcaaagtttttaacttctttgccattggtttgaatttcctcctgtagcttggagtagtttgatcatctgaagccttcttctctcaactcgtcaaagtcattctccgtccagctttgttccgttgctggtgaggagctgccttccttgggaggaggagaggtgctctgctttttagagtttccagtttttctgctctgttttttccccatctttgtggttttatctacttttgttctttgatgatggtgacgtacagatgggtttttggtgtggatgtcctttctgtttgttagttttccttctaacagacaggaccctcagctgcaggtctgttggagtttgctagaggtcactccagaccctgtttgcctgggtatcagcagtggtgactgcagaacagcagtggctgtagaacagcggacattggtgatccgcaaatgctgctgcctgatcgttcctctggaggttttgtctcagaggagtacccggccatgtgaggtgtcagtctgcccctactggggggtgcttcccatttaggctgctcgggggtcagggacccacttgaggaggcagtctgcccgttctcagatctccagctgcgtgctgggagaaacactactctcttcaaagctgtcagacagggacatttaagtctgcagaggttactgctgtctttttgttcgtctgtgccctgcccccagaggtggagcctacaaaggcaggcaggcctccttgagctgtggtgggctccacccagtttgagcttcccagctgctttgtttacctaatcaagcctgggcaatggcgggcgcccctcccccagccttgctgcccccttgcagtttgatctcagactgctgtgctagcaatcagcgagactccgtgggtgtaggaccctctgagccagatgtgggatataatctcctggtgtgctgttttttaagcccattggaaaagggcagtattagggtgggagtgacccgattttccagttgccgtctgtcacccctttctttgactaggaaagggaactccctgaccccttgtgcttcccgaatgaggcaatgccttgccctgcttcagctcacgcacggtgcactgcacccactgtcctgcacccactgtctggcattccctagtgagatgaacccggtacctcagatggaaatgcagaaatcacccatcttctgtgtcgctcatgctgggagctgtagaccggagctgctcctattcggccatcttggctccaccgtatccttgttttaatagaagaaaactgtataatatcaatattggaatggttaaatactgttttactcattatattgatattatacattcattagaagatgacttaattagccaggtgtggtggtgcatgactgtagtctcagctactcgggtggctgaggtgggaagatggcttgaggcaaggagttcaagaccagcctggacaacatagcaagaccccatccataaaaaaaattcccagactgacaaagaaacttaaaaaataaaacatagactaggatctcattaacaaattaacattatatatatataacagatgtgaaataaactaccagaaagattctcttctacatcatatgtcaccagggaaatgtgagttaaaacaatgagataccactacctaccaattagagtggtcaaaatccagaacatgctgtggaaaatgtggagcaccaagaaattttatccattgctcatggggatgcaaaatggtacagccacttaccaaactaagcatactttgaccatactctccagcaatcacactctttggtgtttaccctaataaactgaaaatttatgtccacataaaaactggcacataaacatttatagcaggtttattcatacttgccaaaacatagaacaaccaagatgtccttcagtaggtgaatggataaacttggtacatcaggacagtgaaatattattcagtgcttaaaaaagaaagaaagaagccatcaagccatggaaacatctagaggaaacttaaatgcacattactaagtaaaagaagccaatctgaaaggatatatactatgtgactacaactattagacatgctggaaaagacaaaagatggagacagtaaaataattgattggtagttgccagggttagggggagagagggatcaataggcagagcacaaaggatatttgtggaggtgaaactactctgtgatattacagtggtggtacatgtcattatacatgtgtccaaacctacagaatgtacatcaccaagagtgaaccccagcgtaaagtaggaaatgtgggtaatgatgatgtctcaatataggtttatcaactgtaacaaaagtatcactctggtgaggactgttgataatgggggaggctgagcatgtggggcagcaggggctacaagggaactcttggtattttctgttcaattttcctataaaactaaaacttctctaaaaaataaagtctattcaaaattatatatataatatatttttctctttataaacagacactgtaagaaacatcaaaactatttgtaatagcgcatacggttaggcaggagaggtttgacaaagtagagaagggtaaaagtggaatttttaattgattttaaattgtttgaattcttaaaatgatattcatttatagtgttgatacatttcaaaaataagaaaattagggcaaaggaaaaataaaatagaaaaagtacaatgaaatcaagagtaacattaatacacaagacatgcatatagaattctctacattttctaactgtgagtcataaaatggactctgatcttttctgccaacaatgaccagttaaatcatggtgttaacatgatagaaaacaaacaaattattcaggaggtacacattattcctggcatgagtacctaaataaaaaaatctattctgtgtctctattgagtgatgtttgagcagcaactttaatgctatctttatagcaactcaatgcatttcattgaggtttttctttgtaaatgttcatgtagactgccaaagtgcagcttgataatacctgtcttgtaggtcttgaagttttctaggtaggaactggcaatgggccacaaaacaatgtgatcataaaacatggctctgctatggtcttgtttattccaaaagccatatttagagtgtcctaaactaagctactattttttattctgcaaaagtagattctttcgtcaaatatttcagaaaatttatatcaagccaagttagatgtgtttctttgcctttgggacttcttagagcctttaatatgcaaatatgcattgtaaatctttaagagtgagacagaaaatattgtgtttgtcaagcaaaattaagtctgggagcctatttttgaatgagtgtctccagggctttgattccatagagcacacgtctggtaagcagtatggccagatggctcctccttttaggtgagtctctacaaatagggttttgttattgtggctcttttctttcagtgaggaattgataggccttctcgtgatcccagattttatttgtaggtctattattgtatttcctatttttgctgaatttgatttttctttaccaatttctctaccactttggaaatgcatcaagaacagtttttgttacctcagtacctaataatgccagtgcctagctcagtatttattaactatttttgaaagaaaaactaaacatagcattttcacaggaagattataaatccatggagcattacagatagttctaaggtattttaaatattccaaggctatgcggaaagttaaatgacatctttgttgctgaaattataccatcccaacatgttaataatcatgctgatcagtaactgtggtttggtagttgtagatgtctttatagtagttggaaaacaaattaatagacatagtttgtttaataatttttttcaaatttgtagttagaaaaaatgaaaatacttctgattgtgaaaaaaatgttgaaaaatgtattcagctcctttacagagaggaaaactaaggctaatgtggtaaaagagacttgcctaatatcacacaaaccctttagagcacagtaagtattaaaactcatacttaatcacttccatgcagtaggttttctcttttctagactctcccttttgcaagtttaatggtaacatttctctttctccttgtcttatctcctttcttttatttacatagcatgtgacattctcttgcatgtttcaggtatttttgccatctcaggactgagaggccctggcaaactggcagttgggtaagctgcatttcccctccttaattgatgggaagcactgcctttgacagagctgattcacagtgatggggctgactggctgaaaactggtaggaggactttgcaacagctctgggccaaaccgagtccacaggccatatgtctgcctcctccgtcataaacagacgaccaagtgtgcacactcccaagtgtaatgtcactgggaccttatttgcaaacatataaacgaatgacattcaattatgttcagaggcaatgttgtcaaaaccaccaaggaagcaatttactgctcttgcacagtatgtgactcacagtgcattagcaagttttcattgcttagtttgttcaatatgtttctgaagcagttcttttgcagcctgttgtgtaaccatgatacacacacttatatagcatacatagataggattaaattaagggttgttacagaattatgtcaagtgaaaaaaatgtataataaaatcggctaatttctttgtagacattggccaattaaagggagaaaagcacagtttctacaactagtggagtaaagttattagttgataccaatggatattagcagaaaattgatgaaaggttttaaatttttggctctatgggattccatttttgctaaatgatataatattctcatggtaggaaaaaagttctctgatttacataaaatgcgggtatagcaaaagcaatggtattttaacttaacaacagccctcaaaacacccttataatgttcttggaacaaatgctgtaaaagctgaaagggttcattcctaggtgttcctattggcactattactagtgctaatagaaagcacccagaaaactgaatcagggagataaactataccttcacacaatacataacaacagtaataatcatagtactttgcattggcattatgttttacagtgtacataaacatgaagtatgcccttgaacttgagtatattacataaaacacagatggagtgggcagcttcaaaggaagtatcatcattatttatcatttttgtctttctcatttccaaggttagaaaactgagatttagcgaagttatatgacttatccaaggctatatctcaatactattggaatcaaaagtagatgtggctgagtcttctgaattctagggcaaagtgttttctcaagtaatactgtctcaactgtcaagagtacagttctaccttataactgaaactatcgtaggtatcagaagagggactatatcaggagggcaggcggaggagctccatcatgatggtcctaaaccttgaaagatgggtaatgcttaactaatacaagaaaaaaatgaaagaaattctgagcaaggcaacaccttggataacgattagaaaattaacatttgttgactgatttaataagtattaagcactcataagcaccagctagtgttctaggtactgcgatttggcattgagcaagagacaccatcttagtcttacagaatctatgctataagtggaatatggacccttagaaatgaataacaaaatttaaaaattattttaccttctgttaagaaaatagagtaaatgggttgaaagtggtagagggaaggagtatttcaggccaagtcgtcagagaaggccgctcttaaagatgaccttggaggagacacctgaatgataaggaatgttatcatgcaaatgtccacggaagcattttctggtggatgagaccagtgatgcaacctgggaacaaatttctttctaagtgtgataagaagactttaagaggttctatgtactttttgaaaagatcattattcctgctttctttcataagtccaaaagaggtcatgaatggaaacaggaagagcaggattttttggtagttcatgatatgtaggagaggtttactcagagggagaaagggtgaagtgagagatcaaagcaaaatcctaaatttttggcttgagtacttgaacagatgagataaagaagggtatgaacataagtaggttgtgatgctggccctagttactaaaagggtgtgtatgtttatgaagtagaaaacaacagctggctccatcagggctgtgagtttaatgcagttggactcctcagactgggccgtgatgaggcacggtatagaactgagaagaaggggatctgcaactcagccacaccttctaaaccaacaccccaatctcattttcattgtctgtaaaatgaggggttaggtcacgttgacaaaatttagctaattttaggctctgaactccttttaagaatctaatcattactaacgattctccagaaaacgaaattgaacatatgtttaaaattcccaggcaacacagagacttaagaacttcttggcttgaatattatcaaggattactccagttcgaagtgtttgattctatacaataccaaaataagtcccaaattatagtgatctaacaaaaccatatgtgaccattgcagtgtggcagagagttttgctgcaagtttgcccacgtatgtgaactgatgaagaccttcatcttgtagctgcaacatcaggaatattcagcctctttcttcattgcatagtgagagagagaaccaaaaaccacatagggagttttcactgcctctgactggaagtggcatgcattcctttgaattttatattattggccagatcttatcacctggcacttggcccctaactgcaaatgggatagaaaatagaaaagagtatatttggtaaacattatatattctctttcacataagctttctccttacacagatattttcatagctcaaccagaaacttttggttaaataagcatagacttgtctaaataatggaatactatgaagctgtcataggtttgtaaagattgctaaggcataaaagtctatttaaaaaaagtacaaagtagtgtggatagtctgctgccactcatgtaagaaagaaggaaaatgagaatttatgtttgtatttgtttgcatttggatagaaaatctccagaggataagcttaaaagtgagtagtgatggtgatgggcctcttggatgggaaagatgagagagtgagagcaaaacttttcatagtatatggtctcatattattttgatttttatatgaacattctcagtaatggagggcatcaaaatatcagtggctaattccaaagctcctgctattacagaatgacagcatccgatggaggaggatgttcatgtatcaccaaacagctcaagcatggcttcattgcagtgtaacatgcatcatgtcatgtgttattgcttacttaacaaacctcactctatcccacggattaatcaagataaagtagctaaatattgcctgtctacagatgaggtttccatttgtcaaaaggagatataaaactaagtaaggaattggtagattttctcttcatccactctcagtgctaatataagaacttaaaggggattttttggccgtaattcaatatgacattaatgttagaaaattattcacctaaatgaacaaaaagttttccaaagtaaaaaaattatcttgataatgtaaatttatatgctattcaaacttgaaatgcatgaaacaatttttatggtagtatactttattatgaatcgtttataatttttgaagcaaaaacaatgtgaaatcatagtaaatagtataagatttggaactagacagatataaattcaaatcctacctctactaattgtgttcctatgggcttcttgcttaatcttttggagtttccatttctccatctgtaaagtgaggataacaaaatacttcatgtagttgtgaaaactgaaattagatgtttaaaacacttaatacaacatctgacataataaagcatgttccatagatgtttgctattattaatattacacattggccaattaatcacaacatttacgaatgaggtagatattatttctttttcccaaagatatggtgagattttctgggcagataagaggttcctttcatgatttctcataatatatgaagttagaaggagtttcaagatatgcgaaaacatgctgagacagcatggactagtcaaaaaaatctatgacatctggaactgccattttggaaacatgagctgttgtttagagtaaagataatatttggaaatatacctatcatattgtaagcacttgctaaatgaaagtttttactagcattttgtggcaaaatgagaagatatataactgagaccagtaagttaagccataatcctaaaaaaaaatctgtcatttagtaaatggttcacatttggagaaggttagtagggagttaaaatgtttgaataatttgccattatagttacatttttaccatattattagacttcagtgttttgttttctgaaatctttcctcaaagttgtaggctttatataatcttaaacatgtttcttctttatttttaagcccagtgtatctcaaggagaacttaatttgtatgtttctgattcttttatagttaactaattcaaaagttattttgtaagaattctttgatgtccagaaagccttatcattttcttataatatattcaaggtttttttcctttggaaaatggaaatcatgtcttgcttaaagtaaataaactcaaacacccaattttggaggactgtatcaaatcatattctctctctctcaatttctggtagtatcttggcttacagaaatgaccattcttgttcaggaaagaattggatagtttagcctttttcaagttagttcaattcagtaaacattttttgttacctctgatgtatggagaaatatgcacgtttccatgggtgatagcaataaaaacgatacagaaaaataatatacagtgcatatcctcaaggagtttatattctagaggtagagatagatacatattaaagaaattataatatttgactgaataaaatatccaaaagaggtaaaagcaaaattttatctgaatagtgcaagaagaattatgaattcaatttgaggaactaaggaaggattttcataaaatatatggaattcaagacagccttattagaatttcaaggattattagaatttcagtgagtgaagtagttggaggagggtgtcgctctctcaacaaaaccacttgggcataacatagtaacttcataactctattgcttgtgaagccacaagttacagtactttgaatgccaagctaagagttcatgttttattttctaagtaatagaggagccatttgaatgtccttgaggagaacacgtaatgcaaatgcaatttgggctttagaaagattatgctgatggaactgtgaaggatgaataagagaggaggaaatcaaaaggtttggaaaccaaggctgtgactacttcagttcagtcaagggttaatgaagaaataaactatggtaggagaaaagttacaaaacaaagaaaggtagccaattatgatttctggatttttacttaagatgaatgttagttagaatatagactgagctggctataacaaggagacctaaaactagagcaagtcaaacaagagataattttatttttttcttatataatagaccagaggtaggggcatggccagggtggagaaattactctgcctcataagatcatgcatggtgctgttgaaagaggaaaattgtctctcaaccactctcattctggtctttagaaaggggaatgaggaagtcaaaagcaagaaacttccttttagaaaagtgaccctagaattgtatgcactgcatgcattcacattccattcattgtaagactccaagagaatttttgattcagagtctaaaacttgcttgttcagagcccagaggttttttctcaacattttgtacttacactgtgagtggtatttgaaattaatttgggtaatatagagaagtaggttatagaaagtgggttatagatcccatgaatgcgaggataagtaggagccaaatgaatgggaggaggagagaagacccaagtgaggctgtttctttaccttggcttgaagccagtagactggccttgacatggaggctctggaactgaacgtcttgccacagatttgccagtgatggactgtaccagcagaagcaggagtccacatgaatcctacacaagcaccagactcatttattacacttatcgaccctggtttttaaaattatgtaagtattagtttaatgcctgttacctaaatatcttaagctctatgaggccagggacttggtcttttttgttcaacattgaattcacttcatatatcaaagtgcctgatatatattaggagctagataaacacaggtattttaaatttatgttttaaaaactttcaaacctagggaaaatctgaaacagtagtacaataattatacatgtttgctaaaacttttgctatatttgtatttgcatatttttctttttctcttttcatcctgaatctactgagagtaagttgcaaatgttatgacacttcctaaataattcagaaaagaaggaaggaagaaacaaacaaagacacacctgtctgttatccttttaatttctttacttttcaatttaccatgtctttgtgtttaattatcattccaaggataacttaagtaaaattacttgggaaagttttgtttcatagatacttctaacaagataaactgaagtcatttacatgaatgttatttctgaatattctacgaaaatagatttcatttcataatcacttaagaagctatcataaatcaaaagtcttaaaattaaattttataaatgtttaaatgatgcatttttcccaaagagtaattattagctaaataaaaagagaaagtgcatgccaaaacgtgaatagagtaaaattgtaataaagcagcttttattcacttgagttttagaaatattcttcattggctatttttgttttactttgagaagtgtgattttaaaattgagatacttgtaaatagaggtaagaaaatcattttcagaaggttcagcatatcctagaggatttctttcttctagggataagttatcgacatttcgatgacattcatagaccgccctagaagttaaacatcaataaactcaagacaattctataattagactttaagaagttggaagcgggatttaaaccaagcaaacaagagacttgacaaagcacaaaactgatgttaggaaaacctatagttggtattgccaaaacacaagaacactgtcattcataaaggacctactaacttcccagagacccagatctagtaaaagggcagagtagatataaaagcttatgtttgactacaaacaaataccttttctctagtttaatatacagcctcccaaacaccgaggagaatacttaaataagagaacgggaaatcctctgttgagaaatctcatatattctgtccagaaaataaatggagacattatatcgtgtataaatattcaatatcagaatgttggccaacagatttgttcatagaatagtacagtgtatatttgttttattcccatacgaggcttaaaagttccacacattacttacagataaataaattacatatatattttagctttctagttattctattttacattcacagtaaccttgcaaaggaagtagtgaaacttttagcattcccatttcaaggcaaggtaactaagggacatcaaaattaaatgatttatccagtgtcattcagtttgtcagcactgctgaattataggtagccatgtcccctgcacactctctgtgttaaggattttactgtctagggattctgaatgttcaagatcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatctaggatgaccctttttagcatttgagcggtctctttaaaaatcaaacgaaatatatggtcctcgttctcataaaataaaacaaaaacaaagcaaaactgaaaagaccaagaaacaaaaaggtaaaacagatacacatgggattgttcattacctgtaggttaagaaaccctggtctgggaatatgagattgaatcagtgtaccagctttggaacatagtaagaactgaaagactaatagatgacagaatgttacagacgaattcacaatgagccatgaaggaataggagaccaatggcaaggatatagaagaacctgggcctgaaatatgctagtccttcagtagcatgacttagataaggatctgtatccctggactccccaatttttggggagactatacctggactattttatttgcctgaacatcttaaataaaaattcaagggaaaagcagtaaaagtacataacacaatagagaaataaatgaagaaaaattaaaagtactttagattttcccaacatgaataaagaaaactgtctgtagagatatctaaattataaagagaagaaagacatatttttttatcatggttaatggagttataactagaaacagagaaagctatatatgtgtatttatttttataggaatgaacatatgtactctctcacaaacaaacacgtgtgtgtgcatatgtgtgtatgtaagagatataccatttatctatcttcctagctctctatataattcctttgacaatatcattactagtagattcaggtactatctctcaagggatgtagtataaaacatagctttctctgtagaatgaaaaaaatagactagatatgtgtgagcagattggtgtatgcaatttccaagtaaactccaaggcagtgaaatacgaaagtttaaaaaaaccaagtttccaaaaatatcatagaatttctgaaatatgtatatatcatagagtatatttctatgtaatcaattagtataaacatgccaaaaatattagctattaattaaattggagctataaaataagactattcattgagagttttacatggtatctctgtaaacatgattaaagttctaacccattgtgagatgaggaataggctgcctagcaactgttttaactagttcccctgagattctcaagcaaaaaatgggtgtatggatgggagtatttatttttgtttctatattaaagcttctagatgattcctaactagtcactctcattgtttttcttcttttcatcatctgaaagtaataatttttaaaaatagtaaagaaaagaaagaaggaaggaaggaaggaggaagggaatgaaggaaggaaggaagaaaagaaagatatataaggatcaacatgagtcatctcaagcaatcactgaagaatccaaatataataatgcaaatcaaagtcagatgcttctgtttatcaaatacaggcatatacagctttttgtgtaatgctcacaaatcaaattcaaagtaatgatactggcttaataaactacaggttcattgaaatgaatggcaggaaaggtagcatttcttgattcaggatgtaagggcaactttaaaactctatagctacttcatgaaaccatacattgctaagaagatgttctcataaagaaaacatggcagattaggtcattctcctccttcctgacttcctggttaggtaaaatcacactcataaaacactcccagcacatattcataggatgtcctagcatgttctaccaggagaggggagagaaagtgtttggtggtgattcaagcaacagtaagctatgtagagggttttgagtgtttccttagagagagagagagagagagagagagagagagagagagagagagagagagagagagagagagagagagggagacttcgtttttactacatagctatcataaagcccttatgagtttgagagagaagaattaagaacggatctcaggttaaattccagagttaatgatgtgttaatgaagatgtaggaagcaaaaatgattagtttaaaaggtgagaatctcaagcaaaacaaaagaggtggtaggtctggagtatcaccgataagttacataaataagatgtttattaacatacattacctatttatgcaattatttttgtagcttttgactccattctaagactatattgctaatagggtttagtaaacatagttttgcaaacctacattataaagatgtttcaacctcatacattggcctttaccatcacgttgaatacagaaatactgttctctctggaatttattgtgagtcctgggttcatttacattttatcagtgacccaacatgaaacataacatttactttttgtttagtactttcctgaagcagacaggagaaagtcattgaaattgcttcaaattacctgagaaattgccataatttgcaacttcacaatgcaagcctggatttcccaagttagctctgatctcaatgatgagtttaaatgccaggatgatattttaactatgcagagtcataggcatacatgaaactccattagtttagaatctaatgaagacttatgttgacatatcattctatgtatttcagcatattatctactaagacattataagaacaaaaccccccaaaattccattcttttttgaggtagggtggctttttctcttttaatatttttttacatttgagttcttcatgtttcctgaaggtaaatgatgcatgagaaaacttggaatatcttgactagcattttaaaagcatattaaatattattttcaaaactgaactatgaatagttctgcacaacaattttcttgttggaaattctgatatttatccatttttcctttgatgacctagcatactaatgctatacagactacttcaatcttccccaaagttgtgaaactcacaatttcatgaaagatcaaggatacagatactctttgaaggggtgatttatatgtttagtggaagatggttattttttacaaggactttggattcttgtgaatgtaggttttacaactaagaatatgttagatgttattttttataaatttcatgatagtcctaaatttcattaatgtacaaataaaatgattccatggttaatacagtcccagaactaccagagaccatgttatttaattgctataaatcttccaaaaacaacaacagcaagaaaaaagttaaaattcctacctaacgtggtgtgttatttaaaagggtaccatattcattgctttattcatcctagttttctgcaagaattgagaaaaatctttacatagttgaaggttttataatgaggaaaaaaatcagtagcttgcaaggaagctaaaataggttcaatgttgctaaactgatacaagttgtactctaaaaatgcaacaatcattgagaatatctaggacaaccttctttccccttttttttattttagggtagatcctctgttatggtctcactgctaggaacttcttcacattatttcatagaaatcttgtgtagagcatagaaagagttgtgacagggttgttttgaaatatgtgcttactggagccaaactgctaaatttaccagccatctgacatgagaaaaatcatttgatttttgtgtgccttagtttcctcatctttcaatgcagataataatacccattgcaaagattgcagtgagtattaatatacataaagaactacggtgtctgtccacaaaatatcacatggattgtgacatggcattataacaagcataatgttgtgttggcaaaatactgtatcagttttataatttagtgctttgaggtccaccaaatgtagtttttaatttattgaacaagcatatttgagctctgaaatagttaagatcaactccctaaaattattggtgctacttaggaggccagaggtataaattgttactgttgtcaatgttccacacaaatcacttaggatatgtgaatgtctgctggacagaattcgacttcttttgtggggaactatcttttgtagggaaatgggctcatctttgaagacactgtacaaccaaaatcaaatcatagcaagagacccactttattaatttgtccaatttgattactaagaatttaaccagtattagcttctttaaacatgcaatatgaaataatattttaattgcctggtataagcaatacaccaattaggagatttgctgaatgtcctagcatttgtgcatctttataaacacttcatggatagttccaataagaatccattccatgctgactgctgtgctagggctactcacccagagacgtgataggggctactcccctaagaccaattcctcctggcaggccactcacaatctcacagcaggaggcagctaaacacaaaatcaatattaatataaaatcaactgctatatttttaaagagtagtgtttggattacataagcaatcataaaactcccgttggctttagcaagaggtttagtcctgtaaactccaaaggttttctgtgtgtgctgagcagacaagcatcctaacagaataagccagaactttcctagccatcctagcatgtttgtgccttgtaagatattcccagttacatcctttaatttgccaaagggcagaaaaagaatttggtaagttaactttcccacatgcacaaatttaactgctgttttggtattccacacaggggccagattggatggaagggcaagagggctgctgagggagatcactgcaagtgaaggcaaaatctagtctgatggctcagactaaaaaacttggcctgccaataagagggagcagtgcttccagtgaaaatgtgaggcagtgcctggctttccctgctatactccaccctcctccactccctggactgcctgccaagaaagagaagggtgagcaatagagaaggaagtgaatcactagcacttcacaagtgctgctgcagaggcctgccatagagagctggctgagacctaggtgctctcctgctgatctgagagggcagaaaaataaataaatagaaatgtcaaaaagaggacagcagcagtgtagggaagggaggcagagaggaacaaccccgggcaggaggagtgtgggtcaaatgtgagaaccaataccctccttccctagctaaagttgttcccccatcagcctcagtttccaccatctctgaggcattcacaggaggaataactggtgtgttaaaatccaccaaccacttatatacaggaaagaaaaaaaaaaagatagggtctttaatcttgttgcagtaaaggaaacacaatggaagataagcgtagagcctctcggtgagaggagtggcaggttttaacagagtttctgcttgtgctgaattattgaagaagggcttagggatgtggaagccgatctggatacactgtcaagaagagggggcagtttagttaccggacatttcagtaatctttgttcaggaggccagatcagctaggcaagaaagcagcagtaactcagaagtagcttcagtgtgatcttggccacatcctgttagaaatacactttgtttctgttggccttgtcagtgtcctgttggaaacatggttaatgtcttggcatcaacatcagaattctattactaacagtgctgctttccgtggtctcaagtaggagatccttaggacaaaactccaaggagaaaaggagcagcaggcatcagaattttgatattttgtttattttataaatatggcacatgagtttggctggtgaggccaataaaatacagattttgtgtgtgtgtgtcactagtgtgaaaaaagttgtagtggagagcttggtatgtcaggcaatggtgctaggagaggctgtcttttgggaaatatttcataaaatgggaaacacttggaagaattggtagtttgataaactccataaaagtgagttgagtgttggccataggtgagaacagcatggaaggagtggagggagtggagagaaaagaatgtgtcccaggagaaataaagggctgcaatatttcaatgtacagagacctgagtatgtttgggtttaggagacactgagttacacagaggaataaaatatatggtcgaaggtaaaaagcggcttgggtgaggctggagacagaatcttaaatggagttaatacattattctatatgttcttctgaaggatcaaaaaatattattctctaactttccccaaaatagtaagcatcataaaagtacttttctaagacagttgatccgtatgcaattagcaaagtaaaacagactggaagaaataaaaatattacaaaattggtaaactgttattctgtgtttacataagacaagcttcctaaaacactgcaaagtgtatcattttattatctacacagagcagagaaagcaaaggcaaaatgttaattatgttttatgcttgctgctggattctattacgtatttatgatttttaaaattgtaaatacaatgcaagtacatattgctattatcttcagtttacaaatgaagaaattgagggccatttggtataagtggtttgcatgggatcacaacaatgaagtgccacggcagtgattgcaacccaggtttctctatttctgatgctatactatatgtgttccagtaatccatttcatcctatcttttgtgtccacttagttactatctactacaaattctacttttaaatactatttatttcctcaaaacagaaaaaaacatgaaaatttgtttatcctatctcttcttccaaccactacgtcattcttctattaacttttcttttaaagaaaagtctccaaagagttgctctttccacttcttcaccttccagtctcgtttttttttttcaatcagctttattgcagcataattgacatataatatatacacatcattgttaagttttgatctgtgcatgcacccacttaaccgttactacagttatgaaccaaactcacccatgaaaatttcctcatggttccttgttattcctacttcctttcattattatggattgtagttttctgtattttggcatttatggtaattttgtggagaatgcaaaatttgtgtgaatattactttgttggtgctggttttttttttatttctataaatattcttgagcttcctcttgagatatagttaagttatatgagtcttattataaactttgttgcatgagaagatagtagcatttcatttaggactaagttcacccctctgtttaaacataaaccttctgagcaatctacctgatgtcctgtgaatcatgatgttttccattctggctgttgagaacaacactattcctatccctttgtgagcactgaagacttttccctcataccctttcaggtggttcttttcccaaactcaagtagttttctcacatgcactgagcagtactcagctgtatgtacaagggggactctggagatttctggggttatttctttgtatagctctctctacttcagtactgtgctgtatacatgccagccaccttgatctccctgcaattccagctcctcaactcaaagttctgtgttccacttgtgttcccattctgtggtataagaataaatgcatatttactgtttgttccatttctggtacaaagcagagcctaaaagccttgtaatttcctgagtgataggagtgtcttttgttaataataacaaacttctttcaaccacatttgaatttatgctaatgaggtgaccctcttatggccgtgagatagcttcagggtgggggttggttgtcagaagaaccagccttctcattagaaggttggaactttcagtcccttaacctccagggagagaagaggggttggagattgatttcactcacaagtgaccactgatttaacaaatcatgcctatgtgatggagtctccataaaaaaccctaacccatggggtttgagagcttccaggttggtgaacacattgaaatgctggaagggtggtgcaactggagaggtcacggaagctctgcaccctttcatccatactttgacctttgcgtctcttccatttggctgttcctgagctttataataaactggcaatagtaacattaaaataattaatcgggagaccaataggctgagacaactagcaccttgggttcttacagaagcaaacaaaaacccaactcagtgtcaacagtaacatgaaacttaagcttagctaatcagctactgccagtcaacctctaaggacttccactttaactagtcaaatattttctttgtcatgtttccatgcatcccctataaaagtgtttgcctcatgcccccttaatggagcactaactgcttgttttctggtgctggccaatccatatattgctgcatgctcaaataaattcattaagattttaatttgcctaattttatcttttaatagtctgtaaagctgtttccagtgtctgtaaattgctacagcaaattcttaaccatggggggatgtcctgggaaccccttactttgtagttggccaagcataaaggtaggtagtctaggcaccccattagcaactggagtctgaagtgtggtcagtcttgtgggactgaagctttcaaacctatagagtctcatgcaaactctcggtagttagtgtcataatggaatttaattgtaggacctctggttggtgtaaaaaatcagagaattggaaaattggttgttggtgttagaaaacacccaggtcttccttgtgctatgacctggaagctttctccaggcagtaaatagagcaatcaaaaggctcatgctttttgtcaatggatcattgtctttcattttttaatggtcaatgtattgagaacttttattttaaatattttgtccacttttttagttgcttcatgtgggagagtaagtccagtctctgttactccctcttggcaggaagtgaaaatccctttatctctcgaatctgcaaccccacaactttccatccgcagtcatcatagatgctcctactgttttgttcacgtgtgatcttcaaaggtcaattctcaatcctcgtcttattttatctactactgtcaattcccacatagttacttatttctctcctcccttgctgacttaggttttctagggtggccttcttaaagtgccacaaatggggagtttacaataaacagaaatttattttctccctgttctggagaattgaagtccaaaatcaacatgttgacaggactatgctcccctctgaaactcataaaggaagaattctttcttgtctcttcctggcttctggtggtttgccagcaatctttgtcattcctctacttgtagcagcagcacttcaatctctgcctccaatatcatgtcattctcacctcatgcatccatgtcttcacatgacattctcttctgtgtgtttctatcccttcttcttataaggtcaccagtcatattggatccctattctaatgatctcctttgaatttgattacatttaaaagatcttatttctaaagaagatcacatgcacaggtactgaagcttcagatttcaacatatattttgggaggacaacattcagcctgtaacactgattattctattataccttcttctgaacttctgaaagttgaagcatcctagctgagtcttcagacttcttcttttgcatactccctcagtaataatcttatcgggtcctaagtctttaaacatcacctcaacattaaagtttccaaacattatattattgatgccaatttgtttcctgaattccaaattcatatgttcaactgcaaaatctatatttctaactaaagaaatccaaaacaaagccttttttctgattcctgccgaccctcccatcaaacatgtccttctattctttctcatcttaggaaatgaaaatactatttctcactgttgctcacattaaaaatttgaataactttaaactttgttaaaacccagtaaatctgaaatttagcatcctaaatttaccatctagcatcgtctgatatccttgcccagtcatcattgttttttgtttctaatttaactttagcccttgcaatagttctctaattggtcttcctgtttacattattacacattgtattccatcatctgcaaactaaccacagtagtcattttcatgttcaaaacttttattggcttctcattacacatagaacaaagttcatatttttaaactctaaacaatattgttctatgtaatctagcattgcatcctcctcctcaatctcacttccttcccttcttcctgttgctcactccactagctttctagcttctgtttgaataagtcaagcactttcctacctcaagggctttgcaatagttcctttctgccgggcacagttttctcaaccttctcatgaatttctttccacaaatattctttttttttttttttttttgatggagtcttgctctgtcaccacccaggctggagtgtagtggtgtgatctcagctcactgcaacctccacctcctggattcaagcgattctcctgcctcagcctcccaagtagctgagactacaggcatgtgccaccaaaccaagctaatttttgtaactttagtaaagacagggttttaccatgttggccaggatggtcttgatctcttgaccctgtgatctgcccgtctaggcctcccaaagtgctgggattacaggggtgaaccactgcgcctggctctcttcccataaatattctatagttcaatctctcttttattcaaatctgtgtccccaaaatcacttccagagatgacttaaaccactgtgtgtcctgaccactgtgacttaaacatcacacccaggatttctccagttctctctgctttatttctccttataattctaatcctttattgacattattttagagattttagagatatatgtatttgtttgcatgatttcccctttcctccatcagactgcagccctatgaggatcaggatttttgtctgtttttagtatatttaaaaaattcctgcttaatacataggagttattcaaaatatttctgaaaatggagtaatttttatttattgatacatacctagtatttatcagaatgcctggcataatataggtttcagtaggtatttgctcaatgaatgaagagtttcttaatgtaaactgaataaacagaaacaaattattaggaaatgtaatttagatttaaaaggcctctgttgtttacaaatgaattctaatcaggtaggtactagcagctcctcagggaggtaaaagctatcatttagaatgtggctgccctttctgggtagctttttgttttttctgatcataatggcatgcaaaaagataatacaagaaagtaccaatgctaaggcttacattggtaaagagagagagaatattactcttcagcaattgttcattgttatcagtactggatttgattacggatataggatttatagctctaaatttggagctctaaagaaacctttagttttgaaataactgtaagaatttgtaactcttgagtttccaatattaaatcattttcccaacttttaaaagttagattctccttttatccataaaatggtcctgaatacttgaagtttattataatcacatatctcatgttaaaacaaaaaaaaagctacaatccctgaactaacaattttctttttggggattctgggcaagagggctgactagaagcagctaatatgcaccaatttcaaggagagaagacagtgtgatcagtaaacactagctcttcaactagatcatccaagagtaaacttcggaattcatgaagaaaacaacacaacccacagagaatggagaagcgtgagatatgacaattgcccacccggagtggtacagagccaggggaggcccccacttcgggaaaatggtcagtgagtgagggtccctggggaccacacttctgccatggacccctttgcaatcctgggcacaggaaataccctaggacccctccacccatgggagagaccaccttgactgtggactaatgaagacccccagcatagcagagctgccttacagaaaagtggccacactgttttccatgagggtccccacccctgctactcctcacagggcaaggcctcctgacctaggatctcagaaacacccaacctgggctttcggcctgttgcagctctgcgttttcttggaacagagctcccaggggtaacaggcaggcctgcaaattttgcagctccacagtcctcattcctgctgctctcaggattgggagggtagtgcagggattagggactatcatgggcccccagcacagcacagctgccttaccaacaaacagtcagatggttttctgcatgggtccctggccctgctactcctcactgggcagggggctttttgaggtgtgcctgcagcataactacactgcccgcacctgaatacttcagtcagtggcagctctgcgtttctctgaagaaaaaaatcacagagacatccacagcccctctgtcattgcagctgcagtagtactgcccttactgccttcaggctggggaaggaacaaagggcctggttgatatgccggcacctccagcatgccacagccaccctatgaaaaggagctcagtctttcttccctgtgagtcctcacccccaactcttcaccaggcagggcccctggctcgggaccacagaacagctgccccaccccaggctaagcattcttactggtagttgctctgggtttcccagggatggagctctcagaagaaaccaacagcttctccgctatggctcctgcagtggttctgcccttgctgccccaggactgggaaaggagcaaagagtttgagggctttactcacatttccagcatgccacagtcaccatacagataggagtatagtcaccccttcctgtgagccttgacccccagcttttcaccaagcagggtccctggatgaatattcagccacacccagctgaacattcccgttagcaggatccttgtatttctttgaggtgaagctccaagaggcaactgaaaactcctctgccactgtaactgcagtggtacttcctttgctgccttcagactgggaaaggaacaaagaccatgagtgctttaaccacacctccaataaaccatggctgccctaaagagaagaggccagtctgtctccccaggtcccctggtccccgctgcttgtcattgggcagggactcctggcttgaatccacaacacagctgccccacccagggctgattgtaccaactggtagtggctctgcatatctctgcagtggagccccaagaaacaagtgaaagtcctgctgccacaaccattgccaaggtcccatctcttgcttcctccaagctggggagggaacataaagcctgagcttaccccagggctgcagtgtggatcctgggcatgccaagctaagatctacagccagcattctggaggagctgacactttcagatcactaagagggagcacagatacaattgggaggaagtacagaggttccacatggctgagcaagagcctacctactggccattatgcttcagcaccatctactgagtcatagcccaaacttcatcaccaaaaacattttgctaatatacccacctgtgaaaccaaggacaaaaattagaattcagctacaaataaagaccctgcacaaaggtcttggccttctgaaaacatccagaaaagaagtcaactgacgatattcaaattataccacagttaaaggaatatcagcctacacaaatgagaaaggacctgacccgtagaagaactctggcaattcaaaaagccagagtttctcctttcctccaattgattgtgctggttccatagcaaaggttcttaaccagactgaaagtactgaaatgacagacatagaattcagatatggatagaaatgaaaagcatcaagattcaggagaaagtcaaaattttattctaatccaaggaatctaaggattgcagcaaaacaatacaggagctgaaagatgaaatggccattataaggaagaaccaaatggatctgatagaactgaaaaaacacactacaaaaacttcataataaaatcacaattattgtattagtttgttcttacactgctacagagaactgcctatgactgggtatattataatgcaaagaggtttaattgcctcagagttccacagggctggcaaggtctcaggaaagttataattatggttgaaggagaagtaaacatgtccttcttcacacggtagcaggaagtagaatgagaactgagtgaagggggaagctccttataaaaccatcagatgttatgagaacttaccactgtcacgggaacagcatggggaaaacttcccccatgattcagttgcctcccaccaggtccctcccaccagacatgggattatgggaactataattcaagatgaggtttgggtgggaacccagccaatccatatcattccaccacacccaaatctcatgtcctcacatttcatgcctttccaacagtctccaaaagtcttagctcattccagcattaacctgaaagttgaagtccaaagtctcatctgagacaagggcaagtcttttccacctaaaagcctgcaaaatcaaaagcaagttagttacttcctagatacagtggaggttcagccattgggtaaatacacctgttccaaatgggaaaaagtggccaaaacaaaggggctacaggtctcatgcaagtctgaaatccaacaaggcagttattaaatcttaaagacccaaaataatctcctttgatttcatgcctcacattcaggtcatgctgatgcaagaggtgggctcccatagtcttggggtccaaatctcaattcttgacttctgtgtaccagaaggctcaacaacaagtagaagctgccaaagcttggggcttgcaccctctaaagccatggcccaagctataccttggccccttttagccatggctgcagcagctggaatgcagggcaccaagttgctaggctgcacacagcggggggaccctgggcccgtaaagccatttttttcctcctagacttctggatctgtcatgggaggggctgccacaaaggtctctgacatgccctggagatattttccacattatcttggtgattaatatttctctcctcattacttgtgtaaatttctgcaaccagcttgaatttctccccagaaaatggtttttctttcctatttagttattgggctgcaaattttccaaacttttatgccctgctccctcttgaacattttgccacttagaaatttcttctgctagataccttaagtcatctctctcaagttcaaagttccaaagatctctggggaaggggcaaaatgccaccagtctctttattaaatcatgacaagagtcacctttgctccagttcccaacaagttcctcatctctatctgagaccacctcagcctgaactttattgtccctatcactatcagcattttggtcaaagccattcagcaagtctctaggaaactccacactttcccacattttcctgttttcttccaagccctccacagtgttccaacctctgccggttacccatttccaaagtcacttccacattttcgggtatccttatagcagcaccccactctaccagtaccaatttactgtattagtccattctcatgctgctataaagaactgctcaagactgggtaaattataaaggaaggaggtttaattgaccacagttcctcagggttcgcaaggcctcaggaaacctacaattatggtggaaggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttcccactaggtcactcccaccatacatggagattataggaactacaatttaggatgagatttgggtgggaacacagccaaaccatatcaagtattaacagcagaattaaccaagctgaggaaagactctcagagctcaaagactggttctccaaaatacagttagacaaaaataaagaaaaaattaaaaaatgaacaaaacattcaagagatatgaggttatataaagagaacacattttcaactcattggcatccctgaaagagaggggagaaagcaggcaacttggaaatcatatttcagaatatcattcaccaaaactttttcagcttcacaagagaagccgacattcaaattcaagagatgcaaataacccctgcaagatactatatcagatgaccatcccaaagactcataattttcagattcttcaaggttgacatgaaagaaaatatattaaaggcagctagaaagaaaggacaggtcacctacaaagggaaactcatcagattaacagtgactgtttcagcagaaacactccaatctgaaatagattgggggcctatattctgcatttttaaagaaaagaaactccaaccaataatttcctacccagccaaactaagctttataagcaaaggagaaataagacccttttcagacaaggaaatattaagggaacctgttacaaccagacctgccttacaaaacgtacttgagggagttctaaacatggaaagcaaagaccattaccagccaccacaaaaacaaacttaagtacataggttatggacactataaaacaaccacataataaagtctgcataataaccagctaacaacacaaagataggatccaattcccttcccccacccccccgtgaatattaaccttgaaagtaatgggctatgtgccccagtcaaaaggcacagattggcaagttagataaagaagctagactgcaagactcaaatgtatgctgtcttcaagaaacccatcccacaaatagtgacacccatagactcaaagtaaagggatgaagaaaaatctaccaagcaaacacaaaacagaaaaaagcagggactcctattcttatttccaacaaaacagactttaaaccagtgatcatcaaaacagacacagaagggcattgcataataataaagagttcaattcaatgagaagacctaactattgtaaatatatacccacccaatgtaggagtacccagatgcataaagcaagttctgaaacacctacaaaaagatgtagataaccacacaataatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattggccacaaaacaaccctcagcaaatcaaaaaaaactgaaatcataccaaacatactcttagactacagtgcaataaacaatcaacactaagaaaattgcttacaactatgcaattacttggaattaaacaacctgctcctgaatgacttttgggtgaaccatgaaattaaggcaaacatcaagtaattctttgaaactaaactctagtatcccagagataccagaatctctgggacacagctaaagcagtggtaagagggaattttatagtgatgcccacatcaaaaagttaaaaggatctctaattcataacctaaggtcacacctggaaaaattagaaaaacaagagcaaaccaacgccaaagctagcagaagacaagaaataaccaaaatcagagctgaactgaaggaaattgagagatgaagagcaaaaaagataaatccaaattttaatttttttaaagaataaaaagattgataaactcttagctagactaataaagaaaaaaatagggaggacccaaatagacgcaattagaaaagacaacgaagacattaccactgaccccacaaaaatacaaaataccctcagagacaactacaaatacctatgcacacaaagtagaaaacttagaagaaatggataaattcctagaaacataagctcccaaggttgaacaaggaagaaactgaatccctaaacagatcaataatgagttccaaaattgaatcagttatgaaaagcctatcaattagaaaaatacaaggaccagatggatccacagcctaattctaccaaatgtataaagtagagctagtaccacttctactaaaactactccaaaaagttgaggaggagggactctccctaacgcattgtatgaggccagcatcatcctaatactaaaatctggctgagatgcaacaaaaaaagaaaatgttgggccaatatccctgatgaacatagatgctaaaatcctcaacaaaaatactagcaaatcaaatccagcagaacatcaaaaagctaatccacagcaatcaggtaggctttattcctgggatgcaagattagttcaacgtatacaaaaccaataaatatgattcatctcctaaacagaactaaaataaaccacatgaacatctcaacagatgcagaaatggctttcaataaaattcagcatcctttcatgttaaaaatcctcaacaagcaaggcattgaagaaacatacatcaaaataacaagagccatctatgacaaacccacagccaacatcatactgaatgggcaaatgctggaagcattgcccttgagaaacagaacaagacaagggtgaccactctcagcactcctattcaacatagtactggacatcctagccagaacagtcaggcaagagaaagaaataaaaggtacccaaacaggaaaagaggaagtcacactatctctatctgcaatctgtttctatacctagaaaaccccatagtttctgcctagcagctcctagatccaataaaaaacttcatcaaagtttgaagatacaaaatcagtgtacaaaaattagtagcatttctatacaccaataacgttcaagctaagatccaaatcaagaacacaatcctattcacaatagccaaaaaaggaataaaatacctaggaatacagttaatgacagaggtgaaacataaacatctctacaagaactacaaaacgttgctcaaaagaaatcagagatgacacaaacaaatgtaaaaacattccatgctcatgaataggaagaatcaaaattgttaaaatggccatagtacccacagcaatttagattgaatgctattcctcttaaaacaccaattacattcttcacagaattataaaaaactgtttcaaaattcatatggaaacataaaagagctcaaatatccaaggtgatcctaagcaaaaatagaaaagctggaggcatcacattacctgacttcaaaccataccacaaggccacagtaatcaaaacagcatggtactggtacaaaaacagacacatacaccaactgaacagaatagagagcccagaaataatgccagacagctacaaccacccaatttttgacaaagttaacaaaaaacaagcgatgggagcaggactccctattccataaatggtgctgggataacctgctagatatatgcagaagactgaaactaaacccctccctgacaccatatacaaaaatcaattcaagatggattaaagacctaaatgtaaaacctaaaactaaagaccttagaaggtaacctacaaattaccattctggacataggtcctgggaaaattttcttcccaaagatgccaacagcaatggcaacaaaaacaaaaattgacaaacgggacccaattaaagtaaagagcttccgcacagcaaaagaaactatcaacagagtaaacagacaacttccacaaggggagaaaatatttgcaaattatgatttgatgaagataggttcttcatagattctaatatccagaatctataaggaacttaaattaacaagcaaaaaacaaccccattgaaaagtgggctaaaaacctgaacagacacttttcaaaagaagacatacatgtggccaataagcatatggaaacaagctcaacatcactaataattagagaaatcaaaaccacaatgagataccatctcatgccagtcagaatagctattattaaaaaggcaaaaaacagcagatgctagtggagttgcagagaatggggaatgcttatacactgctggtgggaatgtaaattagttcagccactgaggaacacagtgtgatgacttctcaaataacttaaaacagaattaccatttgacccagcaatcccattattgtgtatatacccaaaggaatataaatcattctgtcataaagacacatgaatgcaaatgttcatcacacactattttcataatagcaaatattgcatgttctcactcacaaatgaaagctaaacaatgacactacatgggtacaaagaggggaacaacagataccagggactactaggctgaaggataggggagggagaggattgaaaagctacctaatagggcctgtgcttatttcctgagtgatgaaataatctgtacaacaaaaccctgtgacatgcaatttacctatatagcaaacctacacatgtatccctgaacctaaaatataacttaaaaataaatattttcttttcattttttgtattaccagtttagttttcttttttacctctcactcagactgttgcaataatctccaagctgtattttgtgcatttcattttcccccatcctatttattctccacattgcttcctagatcttttttttttttttttcttttttttttttgagatggagtcttgctgtcacccaggctggagtgcagtggcgcgatcttggctcactgcaagctccgcctcttgggttcatgccattctcctgcctcagcctctcccaggactacaggcgcctgccgccaagcctggctaatttttttgtatttttagtagagacggggtttcaccgtgttaaccaagattgtctcgatctcctgacctcgtgatccacccgccttggcctcctaaagtgctgggattacaggcgtgagccaccgcgcccagccctagattttctttcctaaaggaaagatgtcaagccactttcttgcttgacaatatttagcagctggcttgccattgattttaagataagctccaaattctccattgtattagctagctatggttatataacaatattgtaacaaatttattgtcttattttttatgatgtcagtatttatgatgtcagtttctgtggctcaggagtccagggatggtttggctgtctactctgattcagagtttcacaaggtttacagtcaaggtataggctggtgctgctgtttcaagctctgaagtttaaccggggaaaaatccatttccaagctcatgtggctgttagtatctttcagctcctgtgagctgttggccagaagctgttctgagttcctggctggctgttgacctaagactgcctcaattccttgttccatgaatcttcccaatgtggacgcttactttgtcaaagccagcaagggaaagagtctccttataagatggagtttacaatcttaggcaatgcaatcacatcacctttgccacattctgtgggttagaacaagccccagactctgcccacactcaatggtaggggattgcatcagccatgaatatcacaaggtcatcttagagtctgtctgccacattcatcaagtcatacaatgcccttaaaatctggtctcaactatccttcttttttctactccagcactgtatattttgtcacactaaactatttttaagaaattatattgaatcacacgaacaactgtattttgttggggggatttttgttgggttttttttgcttccaagtttttctcttgttatcttctgtgcctgaattacacttctgcaccttacctggcaaaattttaccaaagaccttgtgcaaatttcagctcttcttaaaacactcctggttctacccggaaaaattaatagctccttccgaactgtgttcctaaagccctcccaccgccttcctatccattgatttcattatggcataatttggggtgcttgcctaaaattgtaattccagtaagagtagacagtgttttatcaatactgaaccctcaacacctagcacaagatcttgtactcgcaaggacttgtacatttgctaatgaagtgaacaaatattgcattaatttcaaatgtttgctgaactgaatttttgaatgctgtgttgaccaaactactagcagggcaatgtgtttcattcttgaaaagttgtacctttgcattccaaacacaaccttgcctgcttcccagagttccaaaactaaagtaaaacatccaattaatcaatcaattacgcaactgataaatcaaagctagagaagtactctaatcaagcataacttattttcctatctgagatgttttccacattttgtatttgctgaagcagtgcaaaatgttgctgcttaaagacattatgtgacaatctgttttcattcctatgctctaaaaattatgaatagtaattttaatattctttattattttttatattttaaatcagtgttattagttttcccatattaatttattttaatgacatatatgtaatttcaaggtttggaaaactttagatagcaggtcaaattctttttaattcagtctgttcaactgaggtctttatgggcttggagtagatattgctttaggctgtatattagtcaataagctagataataaaaaatggagtatatttttccattttagagtaatgatgaaagtcacataaagacaatttcccaggtaactgaaattaatattcattattgctaaaaagtttttgtttttattttcatgattgggaggaaagcatttcttaattgggttattcatattctggcctcctgaactagaagttcagataatttgaatttctgaaataattatcagtcataacactgtggtgtgatataaccatgcctttaaagcctgttacagggaatctatgctacagattgtaacagctatgcttttcttatttataactgctttttaacttacttttaaaaatgtagtttctttctatcaatgtgcctgcttccagtgctgcctcctccaccaactcttcttaggcatttcgaaacatataaccattgagggtatatatgatcctgacattaaaataaatttattacaattttattattattacttagtagtattgaacatttactgagctcttcctatttgccaaacactgttctaagtccattaggtgtataatctcatttgtcttcacaaagactatgggttaaggtaaatggtagaagagcaataatctcctagacagattaaatactttatgcaaaggaagccctgtggtaaagagagagttagtatgaataaacatggaaacaagtccaaaaaagctggagtaagaagtgtcttggtggaaatggataaaagtgggaattaaaaggtgtgcaggggccagatcttttaaatgctctggttcaaccttacctttagaaacattctgttatacccattgagcaaaataaagcatcctttcttctttgtttcttgaaaacatgacttctactttgaatgacatttggttgtttctgtaatttatcttcattggctctattaatttaactcaaattaaaaccccatctctactaaaaatacaaaaaattagctgggcgtggtggcaggcgcctgtagtcccagctactctggaggctgaggcaggagaatggcatgaacctgggaggcggagcttgcagtgagccgagattgcgccactgtactccagcctgggtgacagagcgagactctgtctcaaaaaaaaaaaaaaaaagaaatacataaaataaattagaaggattggcaaaataagaaatatttcaccttgaggtatatttatatggatatgttattaatatactgaaaaatcgtataacatatttaaaaatctgatgtgtcttggtataaatggtatcagtcaattttggttcagaaataacattcttgtcaattatgtcgtcattaccatggactcagaccaggttttggccatggtcacttgaagtcttcatgtccacacttaattgctttagtctaatgtctttctgaaagcttcttgcaggcaattataatcccagagaattatgtcttcaaggagcttcatggaaagaatgaagtctgacaagtacgggtttctaataactttgagttcacactattgaactaaatttccaaaactcggccaggcacagtggctcaagcctgtaattccagcactctgggaggccgaggtgggcggatcacctgaggtcgggagttcgagaccagcctgaccaacatggagaaaacccgtctctactaaaaaaaaacacacacacacaaaaaaattagctgggcgtggtagcatatgcctgtaatcccagctactcaggagtctgaggcaggagaatcgcttaaacccgggaggcggaggttgcagtgagctgagattctgtcgttgcactccagcctgggcaacaagagtgaaactctgtcaaaaaaaaaaaaaaaaaaaaaaattccaaaactcgaatgaagaaactgatgggtttgtgaaattgctaatacagatcacagcaagaattaatgacaagactgaatgaactgatgaaaaataattattaatctttttttttttttttttttgagatagaacctcactctgtcgcccaggctggagtgcaatggcgtgatctcggctcactacaacctctgcctgccaggttcaagagattcctttgcctcagcctcccaagtagctgggattacaggtgcctgccaccatgcccggttctttttttttttttttttttttttttttttttttgagacagagtttcattcttgttgcccaggttggagtgcaatggcgagatcttggctcactgcaacctctgcctcccaggttcaagcaattctcctgcctcagcctccctagtagctgggattacagacatgtgccaccacgcatggctaattttatattttcagtagagacagggtttctacatgttggtcaggctggtctcgaactcccgacctcaggtgatctgcctgcctcggcctcccaaagtgctgggattacaggtgtgagccaccaaaccaggcctgaatctttttttttttttttttatggcagggtcttggctccgtcacccaggctgaagtgcagtggtgtgatcatggctcacagcagccttgaattccttagctcaatcgatcctcccacctcagcctcccaaaatgctgtgattacaggtgcaagccactagacccagctgaattatggatttttaaggctgctttatgtcaaacattgtgggttcttttaatattgttttccagatttaaggaaacttttttcttttaagctttgtataatttatagtaatttggtacttttgaaaacaaaaatgaaaacatttgcttttcctctctacctgaaccctccagaatttagaagcaatttatgattttttttttattattatactttaagttctagggtacatgtgcacaacgtgcaggtttgttacatatgtatacatgtgccatgttggtgtgctgcacccattaactcatcatttacattaggtatatctcctaatgctttccctcccccctccccccaccccacaacaggccctggtgtgtgatgttccccttcctgtgtccaagtgttctcattgttcaattcccacctgtaagtgagaacatgtggtgtttggttttttgtccttgcgatagtttgccgagaacgatggtttccagtttcatccatgtccctacaaaggacatgaactcatccttttttatggctgcatagtattccatgatgtatatgtgccacattttcttaatccagtctatcattgttggacatgtgggttggttccaagtctttgctattgtgaatagtgccgcaataaacatacgtgtgcatgtgtctttacagcagcatgatttataatcctttgggtatatacccagtaatgggatggctgggtcaaatggtaattctagttctagatccctgaggaattgccacactgacttccacaatggttgaactagtttacagtcccaccaacagtgtaaaagtgttcctcgttctccacatcctctccagcacctgttgtttcctgactttttaatgatcgccattctaactggtgtgagatggtatctcattgtggttttgatttgcatttctctgatggccagtgatgatgtgagcattttttcatgtgtctgttggctgcataacgattattcttatgtttacagcaacatggttatttgcatagattcaaaaagaatctgttctctggccaggcacagtggctcacacctgtaatcccagaactccgggaggccgaggcaggcggatcacttgagatcaggagtttgagaccagcctggccaacatggcaaaacgccgtctctactaaaaatacaaaaattagccaggcgtggtggcatgtgcctggaatcccagctacttgggaggctgaggcaggagaatcgcttgaacccgggaggtggaagttgctgtgagccgagattgcaccactgcattccagcctgggtgacagtgagattctgtctccaaaaaaaataaataaataaaataaaggagggccaggcacggtggctcatgcctgtaatcccagcactttgggaggccgaggggggcgaatcacgaggtcaagagttcaaggtgactatagggagaaaaattatatttcaatagaaaaacgatagtttacctgttattatagtaatgttcattgtttgagttatttatctacctgtagactggattagattctagattcttccagttttctctaatgtctggctacaatctccagtgaagaatgagaactggctgggcgcggtggctcatgcctgtaatcccaacattttggtaggccgaggcaggaggagcacttgaggtcaggagttcaagaccagcctggccaacatggtgaaaccccgtctgtactaaaaaaataaaataaaattagctgggcatggtggcatgcccctgtaatcccagctacttgggaggctgaggtgggaggatggtttgaaccagagaagtcgaggttgcagtgagttatggtggtgccactgcaatccagcctgggcaacagagtgagaccccatctcaaaaaataaacccacacccaaagtgttggtttacagaggctttccaatgcaataggaagcttctggaaactttagggaaagaggaggattaagcaatggagtctagagaaccctcagtggcttgccactgcctttcatttccagtctagttcccctgggaggcagacaggccgagccctctgacattgctgctggaggctgtctctcctggcaaaggcccagggaaactatcctgctgaggcccatctggagctggcagggagctgacattcacggccacatcttagtcataactcctcccctcccctgacacagccacttcctctttctgctgagaaaagaagttgaatgaaggacaagctctcagaaagttgcaacccctaagaacttgagtacaaggaagagacggatgtttattgcaagaaccgttccccggtgtctcctggctcatagagcagctccaacaacacgtgcttggatgccaagtgtgccatggagaccaatccttgctataatcctgatggaaagaacttccccatctgaaaagaggatggtgataagtaaacagattgtcaggggtagaagtacccgtcggaccccaagcctggagcattttgccagagacctttttttttttttttttttgaaacggagtctcgcactgttgcccggggtggtgcaatcttggttcgctgcaacctccgcctcccgggttcaagcgattctcctgcctcagcctcccaagtagctgggactacaggcacgtgccaccacgcctggctaatttttgtatttttagtacagatggggtttcactatgttggccaggctggtctcgaactcctgacctcgtgatctgcccacctcagcctcccaaagtgctgggattacagacatgagccaccatgcccggctcagagacctcttgcatgagccatgattctaccaagcgctctactcattcccccaagaaatcacgtcatccactttttacagatgaagttacctgctaagctagaagtggcaggaagaagccaggtgtggtttgtggctgcttgggaggctgaggcaggaggaatgcttgagcccaggagttggagtccagcctgggcaacatagcaagacctcgtttcaaaaaaaaaaaagagtggcagatgggactagggcctggggatatggcttcaaggatgtctcccagcctgcaggccgcattctcttgccattccagttgatcatcttgacagggaaagtctaccggcacacgcatgcttagatgggccagtatctcccttatctggcccatgaggcctccctctccaggccaagccccactctttactaggcactaaggccttccatgcccccagggcacagattctcccatttctctcccctctttttttttgagatattctcactccaacacccaggctggaatgcagtggcacgctcttggctcactgcaacctccatctcctgggttcaagtgattctcctgcctcagcttccccagtggctgggactacaggcacccaccacacacctgactaatttttatatttttagtagagatggggttttgctatgttggccaggctggtcttgaactcctggtctcaagtgatccactcgccttggcctcccaaaatgctaagattacaggtgtgagccaccacatccacctccccatggttgaggatttgcttctggatcaccgcctccaggaagcctacctctgcaacccctaggcaattttgttttttgagagggtcttgctctgtcactctggctagagcgcagcaggaggcagcaaggctgggacctgagcagtgagtacagctcactgcagccttgaattcctgggctcaagtgatcctccagcctcagcttcccaagcagttgggactacaggcacgtaccactgtgctcggctaatttttatattttgtagagatggggtctcaccacgttgctcaggctggtcttgagctcctaggctcaagccatcttcccacttcggtctcccaaagtgctggcattacaggcctgaaccactgtatctggcgttttttgaaccccagcctgttactcccctacagatcacaccacaacctgcttaggccgcaagcggctcacccggaacaatcccttcgtgccacaagtccctggctcagtgcccttaaccactcaaatcacctaggttttttttttttttttttttttttttttttgagatggagtcttgctgttgcccaggctggagtacagtggcgtgatctcagccccctgaaacctctgcctctcccgggttcaggcaattctcctgcttcagcctcccagctagctgggattacaggcacccaccacgatgcccagctaattttttgtatttttagtagagacggggtttcaccatattagccaagctggtcttgaactcctgacctcaggtgatccacctgccttggcctcccaaagtgctgggattacaggcgtgagccaccatgcccaccccaccctgggatttaagatgcaaatttctaggtctgggatggggctttaaatgatacatttctaacaaattctcaggtgatgccaacgttcacagaccacacttagagtatcaaaggccttcctgctctcagtaggtccaaagctacccaaaccttgctctgaatgcactatagacatgtctgtacccgagtcaacacgctggaggccctgccctcagccagacgggccagagataagcaccatgccagttgcacctgagcatctttcagctttcatcagtttatgcctaatcctgctcagtaggtgccacccccatgttgcccacgaggactggcaggctcacagcaagtagccagccaggctgggatgctgcagcgaaagtgaactttcccgagtgagaatggcttgagtttggggcaaggctggagccagctactgagggatgtgaagcctcccacagaggtaccatgaacaccttccccagcaaagggggcacaagttccctgggtaccctccttggggcaccattcccttactcactcctaggaactatggctgaaacctgggggagggaagcagcctatttagggagcgcgataaaggtagggggaggttgagaagcagctccccccagtgacagtgaggcctcatgtctataatcccagtgcttttggaggccaaggagagagatcacgtgaggccaggggttcgaggccagcttggggaacatagcaagacccagttcctaccaaaaatagaataagttgggcacagtggggctcatgcctgtagtcccagcaactcactcaggaagctcaggcaggaggatggctggagaccaggagttccaggttgcagtgagctgtgactatactactgcactccagcctgggcaacacagccagacctttctctcaaaagggacaaatcaaaacaaaaccaaaaccaaagcaggttctcagctctcctgaggcttcctacccccaaagcaaaagtacccacctcagagccacctcaggaccaccggcttatgacattaggctgcctcctggaatggcttggagtgccagtcaccccttgctgcagctttgacaagttcataccaacatgtcccaagaatagcttcaagcccaaggtgacagctaagaccaggcagaagcagtgctctgatcactgccctactgggagggcccagtcatgactggccttctggcctctagcatctggacagagctgcctgcctgcttgccttggagaagtgggcctggaagctctctcctccccactcccatgtctagagtcaaatccatgggggccagagatataagattctttgctagcctagaagtaaggtgggtccagccagactgaccttcatctaagagtttccatgttggttcccatggaggtgatagattatagttgtctaaggacatgaaccctgccctgtttacagtagagacacagtagtgcttgctggactatgctatgtgagtgcacggggcgggtggtatacagtcgtccccacccgacacagtcagtactaattctgaccttccatctgaccaccacaccacgaccagatattgctttcttcttttattcggaagcagacacagggtgggaggcagtgcgacacctcctggtgagaaccaggataacagcagtcagagtcagggacaccaccacagccaggcctacgcccagcagcaccactgaggtgtcagaaggcaaagcccactgctctacttcatggtcacccctcctgtccaggaagatcagtggccccacggtgacatctgcttcttctgtcactgtgaaaggagaacacacaaccaagggtcatcttagtccctaaccgggaactgggttggaggttttattctgcctcagtgggctaaactaatatgttgtcttttttgtgtgggctaataaacagtttctagacaaaaaaacacagctttctcggccaggtgtgatggcttatgcctgtaatcccagcactttttgggaggctgaggcaggcagatcacctgaggtcaggtgtttgagaccagcctggccaacacggcaagacccgtctctactgaaaataaaaaagttaactgggcatggtggcacatgcctgtagtctcagctacttgggaggctgaggcaggagaatagcttgaacctgggaggcagaggtttcagtgagcagagatcgtgccattgctctccagcctggaggacagagctagacaccatcttggtgcaggggagggggaagaaaaaagaaaaagacagctttctcatacggagaaagcaggtcacccaagagggattccctagtacatcatcttttttgtagagacagggtcttgctatgttgcccaggctggtcgagaactcatggggctcaagcgatttccctggcctcagcctccccaagtgctaggattataggcacaacccactgttctggccagattattattattttttttttttgagagacagttttactcttgttgcccaggctggagtacaatggtgcaatctcggctcactgcaacctctgcctcccagattcaagtgattctcctgcctcagcctcccaagtagctgggattacaggcatgtaccaccacgcccagctaattttttatttttagtagagatggggtttctccatgttggtcaggctggtctcgaactcctgacctcaggtgacctgcccgccttggcctcccaaagtgttgggattacaggcctgagccactatgccaagccagattatcttaacaactgctatatttcccctacatgcctaattatgtctcagtagaagcctaggatgacagcagatctaccctggctgccaccgaggtggaaggctgagagccccctcctgcttaaccccaagatttgtgttagggaaaggtagctgcaggcctaggtacaaacagttttaatggatgacaagggaaaataccatcaccctgaaatgacagcaggtaccctcaactgagtaagggacaatgaacagcctcttggccattctatgacataccatgcctgcggttacagggaagcagacgtggaccactggctcacgacacgaggctgcctcctggaatggcttggagtgccacagtcacctttgttacagcattgacagatgtcagccaggccttccactgggaaccagctgagatgaaagagaagcagcttagatttttgttgcctgcaggaagcagtttgctgataatatattgggggaaatagacaaggggtcgccgattcagtttctactccagtcacggagcacctgtcctcacctgttggaaggcttgctgaaggaacaggccttgttgagttcatctgggtcctgctcagctagggtgaccttcaggtggcaggtgatgtatatctgcaaggaataacagctatttccaggccgagttccaggctgtgcctgggagtttaacacaccagttctcttataaccctcaaccctttaaagagtgagaaggggccgggtgcgatggcacacacctataatcccagcactttgggaggccaaggcgggtatatcacctgaggtcaggagttcgagaccaacctggccaacatggtgaaaccccatcgctactaaaaatacaaagttagctgggcgtggtggtgggtacctgtagtcccagctacctggaaggctgaggcaggagaatcactggaacctgggaggcagaagttgcagtgagccgagatcatgccactgcaccccagcctggctgacagagtgagactgtctcataaaataaacagggggaaggaagagcctcatctctaagatggtgtaaaggttcacttacccaatgttagagcaagtagcaactagttttagactggaatccaccacttattcccctgatcttttccaaacttacccaatcattgaacatgcttgaccctgggcttctgagacagggcctgtcacccaggctggagtacagtggtatgatgatgcctcactatagccttgacctcctgggctcaagggatcctcccacctcagcctcatgagcagctggaattacgggtacaagccactacacctggctaattttggattttttgcagagatgaggttttgccatgttgcccaagctggcctcaaactcctgggctcaagtgatctgtccgcctcagcctcccaaagtactgggattacaggtgccagctatccgtgcctggccagtcctgggcttaactcagcattgctaaacccgcgcccatccccaggtgaccgaggtgagtggtagacaccttaatagctagcagcttagctgggtttctgacgctgccacctgccacttgactagttgacaagctacttttcttcagggatgtagtcactgtattgccagctaaggcaagaccaagttgtttctgggacctgaggtccttgggcacataaagaagccttttggacttgcttctgtggagtttccatttcagacttaagaggttttttttttgttttttttttttgaggtggagtcttgctgttgcctaggctggagtgcaatggcacgatctcagctcactgcaacctctgcctcctaggttcaagcaattctcctgcctcagcctcccaagtagctgggattacaggcacttgccataatgcctcgctaatttttttgtatttttagtagagacagggtttcaccatcttggccaggctggtcttgaactcctgaccttgtgatccacctgccttggcctcccaaagtgctgggattacaggcgtgagccactgcgcccggccagacttgagtttgatggctcactctttgggcaagcttccctgggcttttcttccttgcacatacctctgctattagtcaagcctacgtcagtctcccttcacctgtaagggatatgacgaccagaagactcaccaggctgataccctgacagtcctggcctctgggaaacgtttacccaccctcgttagacaagtacgagggaatgaacccaatatgagctcctgctgggagctgaaggaccccccccacccagggaatagtcaactaccctgtaagcactgcccccctacccttttttttttttttttttctgagacggagtctgtctctagtccaggctggagtacactgtagccactacctccgaggtttaagcgattctcttgcctcagcctcccaagtagatgggattatgggtacccaccaccacaccaggctagtttttgtatttgtagtagagatggggtttccccatgttggccaggcttgtcttgaactcctggcctcaagtgatccacctgccttggcctcacaaagtgctgggattattggcatgagccaccgtacctggccaagccttctcattttagactgacattccatcctgctgctggggctaggggccattctgacagagccagggctcagtctagccttggcccgtccccaggtcagtttcccttcatatttcaggcagggctaaaattcctccctgctcaacctcgggcagagcatggcaattctgccaccttgcagcagaagcctcagagccacaagcctcagtcaccacctagtggccgagtacaccagcagagaaacttgaaaccatgtaaattcagacttttagaaacaagccagtttagcagttgtccagctgcccatcttagccacctgccctgcaagtaagaagcttccaaggccctgttgtctattccacaaaggaaatgtactttcatccttagcttcttcctagtatgtttttctggtgctaactggagtctaagatcccagggcagttcccctatagcggccttttagaagcagggtctaggctgggcgtggtggctcatgcctgtaatcccagcactttgggaggctgaggtcagtggatcacctgaggtcaggagtttgagaccagcctggccaacatggtgaaaccccatctctactaaaaaaaaaaaaaaaatacagaaattagctgggcatggtggcaggtgcctataatcccagctacttgggaggctggaatggaagaattgcttgaacctgggagatgggaagttgcagtgagctgagattacgccattgcactctagcctgggcaacaagagtgacactccatttcccccaaaaaaaaaaaaaaaaaagaggggagtgtgatagctcacgcctgtaatcccagcacttgctgaggcaggtggatcacctgaggtcaggagtttaagaccagcctgaccaacatagtgaaaccccatctctactaaatattcaaaaattagccaggcatggtgattgagtgcctataattccaactattagggaggctgaggcaggagaatggcttgaataaggaggtggaggttgcagtgaaccgagatcatgccattgcattccagcctgggtgacagagcgagactctgtccaaaaaaaaaaaaaaaaaaagtacacagggtcttgctctgttgagggcaatagcaccatcatagctcactgcagccttaaacacctgaactctgatcctcccacctcggcctcccaaggtgctgggattacagatgtgaaccaccgtgcccagccaccctattgctctgaaatagggttgttccttctttgtgccatgggacatagtctactgaggcatcatcaatcctacctttgaaggggagccctccaagggctcagactatcttccattaaacagcactgttctctggtcttagttacccctccacacccagagattgagaaaccacctcagtccatacccatgctgactgctaccacctctgtgaaaacttctccccatcttcttcccaaatggccacacctgaggtcaatcttgacttcctcccacaaccaggatcctctcccctaaggagctatcggtcactgatccgagggccaggactcttttcccaaatctgccctcctttatccccagccccattgaagcagggcccaccactgagagcttcaggccatctcatcaatattagatgcttttcccttttgctaccctactgatctgtgtgttgatctttctcttcccacaaggcagctgctggaggaggtgaagtggcatcgatgtcatctttgaaaagtttctactttgtcccttaatgccaccctaacgtatgagcctctgcttcagaggtttgcaagcctggctgcgtattagagtcacctaggagcttaagtggcttttgatgcatttccaagtagaataaggtaggtcagtagatggaggataacagtaaaatgctagcaggccgggtacagtggctcacgcctgtaatcccagcactttgggaggccaaggcaggtggatcgtttgaggtcgggtattcaagaccagcctggccaatacggtgaaaccatctctactaaaaatataacaggcactcagtagtggcgtatgcctacaatctcagctacttgggaggctaaggcaggagaatcgcttgagcctgggaggtggaagttgcagtgacctaagattgggccactgtactccagcctgggtgacagagaccctctcaaaaaaaaaaaaaaaagggggggggggcaggtggcacgtggtggttcatgcctataatcccagcactttgggaagctgaggcggttggataatgaggtcaagagttcaagaccagcctggccaaaatgatgaaaccctgtctctactaagaaatacaaggattagccgggcatggtggcaggcgcctgcaatcccagctactcaggaggctgaggcaggagaattgcttgcacccggaggcagaggttgcagtgagccaagaccgcaccattgcattccagcttgggtgacagagtgagactgtctcaaaaaaaaaaaaaaaaaatgctggtggtagaacctagatggtgtgcacactgaagttcatagagttttacagcaaacacctatgaagatttagttaatgttacaaaatgtgacaccaggccctaccccaatagagtgaaggtatgagactctacaatcagtatttttacaacctctccagatgattagtatagagccagcactggaaacccctactttaatcacttcctaaccacctattctaagctcacggcctcacctctcatctcagtgagcttgtttaaaagctacttgaggctgggcatggtggctcacgcctgtaatctcagcacttttggaggccgatgcaggtggatcacaaggtcaggagttccagaccagcctggccaacatggtgaaacccaatctctagtaagaatacaaaagttagccgggtgtggtggcaggcacctgtaattcccagctactcaggaggctgaggcaggagaaatgcttgaacccaggaggtagaggttgcagtgagccgagactgtgccattgcattccagcctggactgcagagcgagactccaactcaaaaaataaaagctacttgaggctgggcatggtggctcacgcctgtaattccagcactttgggagaccgaggcaggcggatcacctgaggtcaggagtttgggaccagcctggacaacatggtaaaaccttgtctctactagaaatacaaaaaaattagccaggcatggtggcgggtacctgtactcccagctacttgggagactgaggcaggagaatcacttgaacctgggaacctggagtagctgggactacaggtgcccaccatcatgcccagctaattttttgtatttttagtagagggggtttcaccgtgttaaccaggatggtctcaatctcctgacctcgtgatctgcccgcctcagcctcccaaagtgctgggattatgggcacgagccaccgcaccaggcaatttacttctaaccacttctaaccacttaccagtacttcctggctagatgttggtcctggcacctgcacttcctactgcatccctcccccacctcagccattaggcagttcccatcttcattccttccttctccttccctcttagtgtcaatttgagttttctagtttaggttctcaaggggaggacccagactggcagaaccaacacttaagaatgcagattctaggcttcactagaccacctgaatcaaaccctgggttggggcccagtcatcaatttcaacaagccctccagctgaggatgatgccttcagaatcactagcctaacctatgaccaagttcaagaagccaccctggctacgaagttcacactggttttctttgcccctgcagaaagcctccaggaaggctaacacctgcctttttttttttttggagatggagtctcactgtcactcaggctggaggtgcagtggcacaatctctgctcactgcaacctctgcctcccaggttcaagctattctcctgcttcagcctcccaggtagctgggattacaggtacccaaccaccacactcagctaattttttttgtatatttagtagagtcggggttttactatgttggccaggctggtcttgaactcctgacctcaagtgatccacccacctcggcctcccaaagtattgggattacaagcatgagccaccgtgcccggcctctacctcttaaggcttcatattgttcatccttctgcttgaaggcctcgctaaagctcatggctttacttgtaagtttgagttactgggacacagctctaagtcatttgcttaggggtggagctagtgagtgaccccattcagtaggatatgaaggttgcaagttcagccttctttcaggctgttaaagctcttaccatgtttctggagtcattagcaaagtggaagacatccactgtgaactggagtgtatctggcccgggtcgaggaactttgaatgcagaagaggcatcagtgagaccgtcgacaagacagcttggaagaaaacagaacggtgttaaagccagacaggtgggccgggcaccgtggctcacgcccataatcccagcactttgggaggccaaggtgggtggatcacttgaggtcaggagttcgagactagcctggcaaacatggtgaaaccttgtctctactaaaaatacaaaaattagctgggtgcagcagtgcacacctgtaatccacctactcgggaggctgaggcaggagaatcgcttgaatctgggaggcagagggtgtagtgagccaaaattgcaccattgcactagcctgggtgacagactgagactcggtctgaaaaaaagaaaaaaaaggaacgttcaaaatagagggtagagaatatgagaatatgcacccatttgtgttttttaaacaattgcatacaataaacgggcttacagacgaagaaagtttctgggaagagacccaagaagcccccagaaggtagggggataagctgaagaattgttaaagattttatttatttattttttgagacagtgtctcccaggctggagtacagtggcgtgatcatagctcactgcagcctcgacctcctgggttcaagtgatcttcctgcctcagcctcctgagtagctgggactacaagcgtgcaccaccatgtcaggccgatttttgtattttttgtcaagatagggtctcaccatattgcccaagttggtctcaaactcctgggctcacgcattcctcttgtctcagcctcctaaagtgctgagattacaggcatgagccaccacgcctgactgaatttttaaagatttagagagggctgtcagctgggcgcagtggctcatgcctctaatcccagcactttgggaggccaaggtgggaggatcacataaggtcgggagtttggccaacatggggaaaccccgtctccactaaaaatacaaaaattagccaggcgtggtggcatgcgcctgtaatcccagctactggggaggctgagagaggagaatctcctcaatccagggggcagaggttgcagtgagccgagatcgtgccattgcactccagcctgggcaacagagtgagactctgtctttaaaataaaataaaataaaataaaatagggctctctcctctctggcagtatccccactccccacaacatacacagtagggcagtttgccacttgcgttcttgcataaaggtccacagcctaaggggcagtggcaggagcagcggcaggaaatattcctggcaggggttctttgtctgaaattttccgcctagagatggtgtctttttttttttttttggaactcctcaaaggctggggtttgttcaacacacccaaggggccaccagtgctctgaagcaactgaaaatgaatgacgtggcccaagaaagaatgtgactgttggccacaaaatggggagtggtgttgagcaaagaaatttaaactctaatacccataatcccagcacctggctaggtccaagtgggaggatcgcttgagctcagaagtttaagaccagcttgggtgacaagacaagaccccatctctacaaaaaataaaaaaattagctgggtgtggtgggacacccctgtggtcccagctacttgggagactgaggcaggaggatcacttgagcccagggggtccaggctgcagtgagctatgacgacaccactgcattccagcctgggtgacagggtgatatcttgtctcttaaaaaaaaaaagggccgggtgcggtgtctcatgcctgtaatcctagcactttgggaggccgaggcgggcggatcacaaggtcaggagatcaagaccatcctggctaacatggagaaaccccgtctctactaaaaatacaaaaataaaataaaataaaattagccgggcatggtggcgggcgcctgtagtcccagctacttgggaggctgaggcaggagaatggcgcgaacccgggaggcagagcttgtagtgagccgagattgcaccactgcactccagcctgggcaacagagtgagactgtctcaaataaaaaaaaaaaaaaaaaaggacaacacgtgggggtggggtatggggtagagggtatttgcaaacttttcagatgaatgaacggtgagcacacgtaccttattttagatttgccacaagggaaccagtgaaaagggtgagccttttcttttgtttttgagatggagtttcactcttcttgcccaagctagagtgcaatggtatgatcccggctcatgcaacttccacctcccatattcaagtgattctcctgcctcagcctcccaagtagctgagactacaggcgtgtcccaccatgcctggctaatttttgtatttttagtagagatggggttacgccatgttggccaggctggtcttgaacttctgacctcaggtgatctgcctgcctcagcctcccaaagtgcagggattacaggcgtgagtcacctgcccagatgggtgagccctttcaaaacatgttccaaggggctgggacttacataagataattatttggggaagactggtttactcctcagggctgtaaagccatttttttttttttttttttttttttgagacagagtctctctgtgtcgccaaggctggagtgcagtggcatgatcttggctcactgcaacctctgcctcctagatttaagtgattctcctgcctcagcctcctgagtagctgggattacaggcgcccgccaccacgtccggctaatttttttttttgtatttttaatagagatggggtttcaccatgttggctgcaaagctatcttgcttttctttgttgtgcaggtcacacctgggtcctgagctggcgccatcaccggagacgccaggtgatgtccattcatcagaaataatgagcaaagcagctgtggcttctaatcagcccatccctccagggtgtcagatggaggccaattagcggacgcactagacaaccaaattctgcctttccaagcaaaacatcagaaaatgttctagcccttagcattgatgctggaacccagtgtcttgcttctgcttgggttttcatgatctttccttgctctgggtgagctgggggctggttctacatcagaaccttcagaggcactaagaaatgccacctggagtggagttaaagaagttattatttttttttaacttctactattgtcagaggcgggtgaaccagagcaactccattttgaataggggctggataaaatgaggctgagacctattgggctgcattcccagatggttaaggcattctaagtcacaggatgagatgggaggttggcacaagatgcaggtcataaagaccttgctgataaaacaggttgcagtgatggccgggcgcggtggctcacgcctgtaatcccagcactttgggaggctgaggcgggcggatcacgaggtcaggagatcgagaccatcctggctaacacggtgaaatcccatctctactaaaaatacaaaaaagtagccggatatggtggcgggcacctgcagtcccagctactcgggaggctgaggcaggagaatggcgtgaacccgggaggcggagcttgcagtgagccgagatagcgctactgcactccagcctgggtgacagcaagactccgtttcaaaaaataaataaataaataaataaataaataaataaaacaggttgcagtgaagaagccggttaaaacccaccaagaccaagatggcgacgagagtgacctctggtcgtcctcactgctacactcccaccagcttcatgacagtttacaaatgccatggcaacgtcaggaagttaccctatgtggtctaaaaaggggaggcatgaataatccaccccttgtttagcatatcatcaagaaataatcataaaaatgggtaaccagccaccctcggggctgctctgtctatggaatggtcattctttcattcctctactgtcttaataaacttgcgttcactttatggactcgccctgaattctttcttgcgtgagatccaagaaccctcacttggggtctgggtagggacccctttcctgtaacactatcattctcaagttttttttttttttttttttttgagatggagtctcgctctgtcacccaggctggagtgcagtggcacgatctcagctcactgcaacctccgccccacaggttcaagcgattctcctgcctcagcctcccgagtagctgggattacaggtatgctgtaatttttgtatttttagtagagacagggtttcaccatcttggccaggctggtcttgaactcctgacctcatgatccacccgccttggcctcccaaagtgctgggattacaggcgtgagccactgcgtctggcccattctcaagttttgttttgttttgttttagagacaaggtctcactctgttgtccaggctagagtgcagtgatatgatcacggctcactgcagcctggaactcctgagctcaagcgatcttcctacctcagcctcttagagtgctgggattataggcttgagccactgcattcaaactcgagccctttttcttttttaatctaaattcctttttttttttctttttgagttggggtcttgctctgttgccctggcgagagtgcagtagctggatcatatctcactgcagcctccaactcctgggctcaagtgatcctcccacctcagcctctggagctgggaatacaggcactcaccaccatgcctggctaattttcatattttgtttggtagagatggagttgcactatgttggccaggctggtctctaactcttgggctcaagagatccctccacctcagcctcccaaagtgctgaaattacaggtgtgagccaccgcacccagcccaaattgattgtggttttttttttttatttcacttttccccctgtgatacagccccaggagatccccaaataaattcttaaaacagtcttatgactctttaatgtcagaaatcctatctataggaacaatggtatgcaatggtcaggaactagtgccacctgacttttagcaacaaggaagtaggccaaaatgcagcctgatgaatgcttaattataactctatttctgtccagaacccagcatgcagttcttgttgctcctgtggggatagtttcattctcattgtaaatgaatattctggtgtgttgctttgggatatataagttgttcaagaaaagggatcaagcctggtgcggtggcttatgcctgtaatcccaacactttgggaggctgaggtgggtggatcacctgaggtcaggagtttcagaccagcctggccaacagggcaaaacccccatctctactaaaaatacaaaaattagctggctgtgatggtacgcaactgtaatcccagctactcagcaggctgaggcaggagaatctctcaaaacctgggaggcggaggttgcagtgagccaagatcgtgccatttacactccggcatggctgacagagcgagaatccgcctccaaaaaaaaagaaagagagagagagagaaagaaaagcaaagcacgcttggtgaccgtgctaggttttttgagataagttttttgttaaataagagcaattttgtttaagttgggggttatttaaagattgtttcaaaatatggatttaggaaggaaatagaaacaaggtgggaagaaggccagtaagtaggagagacgtgaaaaaaagttatgaggatgtatttttggtaaagaaagttgaaaaaagagtaattttttattttgcatgagagaggactttggtcaaaatcaagaggaaaggaaagtaaatttctgtcctaaagtagattgctaatataaaaaaagtataggacaaaatcaaagatttaaggaagtgtagaagttgtggaagattaatctcatgaaaggaatttggtgtgtgattaagctggccgaaattagaaggggattatttataagattttcggccaggcgtggtggctcatgcctgtaatcccagcactttgggaggctgaggcgagctgatcacctgaggtcaggagttcgagaccagcctgctcaacatggcgaaacccacttcaacttcttttctttctgtaattagaaaactattccattttcattaggttattttacaaaccacataaggaatttttttttttttcagacagtctcgctctgtcacccaggctagcatgcactggcatggtctcggctcgctgcaacctccgcctcctgggttcaagcaattctcctgtctcagcctctggagtagctgggactacaggcacctaccaccacatccagctaatttttgtatttttagtagagacggggtttcaccatgttggccaggctggtctcgaactcctgacctcaggtgatccacctgcctgggcctctcaaggtgctgggattataggcgtgagccaccttgcccttccaggaaattggttttaatctcattactgataaaactaccaaactctagttttcatttttctttcccaagcatttccttcagcacaattaagacactagaactggtgggccgggcgccgtggctcaagcctgtaatcccagcactttgggaggccaaggcgggcagatcacgaggtcaggagttcgagaccatcctggccaacatggtgaaaccctgtctctactaaaaatacaaaaaaattagccgggcatggtggcgggcgcctgtagtcccagctactcgggaggctgaggcaggagaatggcatgaacctgggaggctgagcttgcagtgagctgagatcgggccactgcactccagcctgggggacagagacagactccaactcaaaaaaaaaaaaaaaaaaaagacactagaactggtggttacccaaataactgaacaccacaaaattccgaccagaagacttagagccttctttcttgaaaataaacttttaacacgtttctacagaagcatgaggctaacatggctaatagctgtcagcttatctctgctactcacagaaaaggtaaattatgacatcgatctaacctgtgccttgaaatgatcagcattaaaacccctgttattaggttctttcatgaaagccaaagaaggaggcctatgaaggctcacaaactggaggtggcctctgtatctttacgggaatgtctacatctcatcccataggagtccaagcgggaaactggcttagtactctcctgagcctgttaccttcttttattttcctggccatcaaggaatatttggtcttcttcctccactgtccttttcttcttcttctctttgagggcactcagtacagtctcctttgcacatgggtctggggcattacttgatggtgaggacagtgttgagctgattatctgctctggtctataatgaaagacaggattctagcagtaagatattttaattcccatgccatatcagaaatggaaatcagaagctaaccaacaagccaaagtataatttatacactcacaacagttccccttagcaagtaaagctactttttcgttaacggcaaaaagtgaaaaacaaacggttttactagaatttggtatttctcattcaaacaagcagattcgtcctttcttttttgcgttgtagtcatgttgtcataggaacaactggagaagaataaagtggacacgaaaagggagagtattcttccaacgataatactcacatcgcagaacgcgaaaatcttctgtcaggaggggcgatcctcagagtcactgggctacacaccatcctggagttgcgaggggacagcacagccttcttgtgataaccattccagcacactgtgggaagtacccccggacaggaatactgggcctgatggatcggatagcgtcttcgaggtgttattacaaaccgatctggtaaagtcccacgatccctgcagagaatgcgagacaaatcatggaaacaaagtataaaagaatgtcaaaattttagacggttaaaaacccaccagttaagacattttccaaagaacttaagtctctttctacgcaacacagaacacgttgtttttatggcaactttcccctattccatctaagagcagagagtgacagctgcttaacagctgtctcaacaatggattgcaacaatttgagagggaaaatctaaatctagactaaatctagactgcactaaaattcggggagtttttagaactggaaagaagggaatcgttttggcaacacatctcacaccaagcaagagtcagaggccaggagacggctggcacacaccaaggtgttaaggagggcaaaaccacacacaattcccttcggatttgatgaaaaagcaaatcggatttaaaagtcctcgatttcaagccagccgagccaaaggatgatctgggaaaatcagcgcatctcaccgtggggaaggcctcccggagggtcggagaagaggagtggggagagaggggtaaaagtggtgaacgcgatgggtcggcggggagggcggtgtggagcgcggcgccgggcgggcgggcggcggccaggcctattccgcaggtcctggccctccggagcgggggcgggctgcggcggcccgggcttgcccaggtaactgcccatgaggagcagttcggcagggtcaggtccttcgagcagggtccgcggctctaggaggtttccgttggctgtcgacttggccggaggcgaagcgaacagtgttcgccgatgtcgcgccttctgaacgaaggaggacaaggggcgcgaacctcggggctcgcggctcagtccccaccaggccgcggtagtccccacggccagccaggccagcgcagccgcagcaggcacgaggtacagtaggaggccgaccagcgacaggccgagaagcgccgccccggccggccctgacactcgctatcggccgccgccgctcgcctgctccagccgccgcagccgccggagacatcgcggctccgcgccgcggaggagacttaaatatcccagcgtgcaccgcgccacgcgtcgcgtcatcgcgcgcccgccacgtcatgcgcgcgcgactcggggagacgctacagcccggcagctcccgagacacagctgttttggaaaatgctgcctgccttcaacgcctgtttctgactcttgcggtttcccgcatggctcccagcgagacgatcccgtccgggatcccatccggctcccatccggaggcgatcccgtgaaaggatcgcgtccaaaataaaagggcccgagacctatgcttatgtaattcctaatccgtgatcttttctaggggctgaactcccctccagcacagcctgttaccaggtgcttttcacaaacgccactggcggctgagttttcccccccacttccatttctactttacaagttgataacgtgggacgattacctaccaaatttcacatcatggcccagacatcgggtggattttgaggctctgtgatcgatttatacctatgctaaagttatcggtctgagaaagtagattagtggttgcctagggctaaggagtgggtttgggggtggggaatagaaaatgactgcttatgggtataggctttctcgtagcagcataaacatagtttaaaattagatcgtgttggcggttgcaccaccctatgaactgtatggtttgtgaattatatcttcataaagctgtttaaaaagtctggtagtctgccaatacactttggtgtagttaagtttcctcagacattcattcattgatttattcattccattgtttatatacattaaagagattaagggggaaaatagaggatctctgatctttataagctctgtttagtaaggaagatgtgtaagtaaaagattgcaattcaatgttatcagtgtgataacgggaacaaaaaaagaggccagacgcagtggctcatgcctgtattcccagcacttcgaaggcggaggcgggcggatcacctgaggtcaggagttcaagaccggcctgaccaatatggtgaaaccccgtctctactaaaaatacaaaaattagctgggcatggtggcgcgtgcctgtagtcccagctactcgggaggctgagacaggagaattgcttgagtccgggaggtggaggttgcagtgagccgagatcatgccactgcacactccagcctggacgacagagcgagtccatctcaaaaaaaaaaaaaaaaaaaaaaaagttgtgataaaggggaaggaaggcagggaagtgctcctggagctgagaggtctggcaggttcaaggaagatgaaggagcactgtgcagaagtccagagatggaattgttcagtatcgctggagattagggtgttttggggatagaaaagttggaaaggtatagatgcctctggggcaactcagagagatgagaagaaggtgcagtttgggttccagatcctccccaacccagtgccaaagtaattcttctatttaatatactgtgatttcacataagacttaatttgaaaaaaaaggggggggggcggaggggggactgtgttgcttaagaaaaaaatctcagtatcagtagactagtgggacaaaagccaggctgccctgggttgaacagtgactggaaggtgaagaaatggaggcagtgactgcagactccctactcaagaaacctgggtaataggggaagaagaaacatagtgtctaggtcagtaggggctctttgaactattgtgtgtggctggagttaagtggaggagctacacataaaagccgtcagggtacagatgtcctgaaaccaagcaagatgactgagaattaatgtaaatagagaggtccatagcctgagccctcggggcactcctgtgtttagaggtaaagagatgaatacacaaagggcacaagtcatgtaggaaatatagataaatatgactacattaaaagttagtacttctgggccgggagtgatggcttacacataatctagcacatttggaggcgaggctggtggattgctttgagctcaggagttcgagaccagcctaggcaacatggtaaaacccagtctctactaaaaaaaaacacaaaaatttgcctggtgtggtggcatgtgcctgtagtactactcaggaggctgaggctggagaatcgcttgaacccagaaggcagaggttgcactgagctgagatcgcaccactgcactccagcctgggcaacagagtgagatcacacacacacaaaaagttaacacttctgtatgggaaaagacaagatacacatctaaaagacaagccaagactgggaaaaacaacgtaacacatataaccaaaagaggattcataagtagaatttataaagaactccaaagaatcaataacaaaaagatgacccaacttttaaaaaggacaattgatataaaaaagctatcgaatgggaaacacaaatacctaataatatatacatatgtgcatatacgtacatacacatatacatttaacctcactagtaatctaggaaagactaacaatattttgcactcatttatacactagaaaaattaatttaacaagatcaagtcttagcatggatgtgaaacaaacagaactcatgccgttgtggatatatgaaacagtacaatttggaaagcaatttggcaataactagtaaaaaataagggtgaagaagtatgtatcctataaacccgcaatcccattctgggtagatagtcactgaagcattatttgtatcacagacaatgtgaacacacttcatgggtaatgtctatcaacacaaggatgggcaaactggtataattcatataataaaatactataaagcagctgaaaattaatccttccagctgcaggttagtcctcccaccataaacaactgtagacatggacaaaatgtattgattaataaatttgttaaaaaaaaatctggcagtctgctgatccagactttggtttaactcatgctgtggtggatatataaaacagtacaacttggcaactactttcaggcagaggacaacaggaagcaaaagactgatccctaagtgtaaggaaacttgtgagatgagccccaaagtcacctagttcctctacctggggatcgtttcccaactgcagtgcagagagctggagtctgagcacagtagggagatcccgctgggctgaagaggcagagatgaggaggcagagatcaggctgagacagctgaaatggcagagaaatggggcagaaaaaagaaaggagggcactatgcaaagagggagttctagaaatctatgcatgacgcaaacccacggctgaaggctggagtgatgggtaatttcatgtgtcaacttgaagggaccatggggtgcacagatacttggttaaacatttatttatgggtgtatctataaaggcatttctggatgagatggtcttttatttatttacttatttttattttttgagatggcgtgttgctcttgtcgcccaggttggagtgtagtggtgcgatctcagctcactgcaacctctgcctcccaggttcaagcgattctcctgcctcagcctcagtggagtagctgggattataggcacccgccaccacacctggctacatttttgtatttttagtagagactgggtttcaccatgttggacaggctggtctcaaactgctgacctcaggtgatctgcctgcctcagcctctcaaagtactgggattataggcatgagccactgtgcccagcctctttatttttttgtagagatgggggtcgccacaaatcagactggaaaaactcacaatttatagggctctgtgtggagtactcaagcaccccaggaatgggaaagaatcagtcttagattgagcattgctttggacccacctaatgaatcatcaaaacaagacctgaaaggatccaacttttcaatgatcttaaatacatcccaaaacaaagctcaagaaaatgtatataggaataaaaaattggctgggcgcggtggctcacgcctgtaatcccagcactttgggggggccgaggtgggtggatcatgaggtcaggagatcgagaccatcctggctaccacggtgaaacgccatctctattaaaatacaaaaaattagccaggcatggtggcgggcgcctgtagtcccagctactcgggaggctgaggcaagagaatggcgtgaacccgggaggcggagcttgcagttagccgatatggcgccactgcactccagcctgggcaacagagcgagactccgtctcaaaaaaaaaacaaaaaaaaacaaaaaaaaatgaccattactcaacaaggtaaaatctccaatgtctggcatcctggcatcctattactaggcatataaataagcaagaaaacacagcccataataacaaccaatcaatccttattttgatccaaaccaaccccaaactgacacatattaaaatgaacagagaaagacattaacattaattttaactatatcccatatgtttacaaagttgagacatggaaaaatattagaagaaataatggccaaaaattttccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaatttcttgccagaaatagtgcaagtgagagacaacagcagtgcaacttgatctttaaagtgctgaaggcaaaaactgcaaacctagaattttatgcccaatgaaaatatattttaagaaagttaaataaacatattttcagacacataaaagctggcagacactttgagaggctgagctgggcagatcgctcgagccccagagttcgagaccagcctgggcaacatagtgagaccctgtctctaaaaaaaaaacaaaaattaggccgggagcggtggctcacgcctgtaatcccagcactttgggaggccgaggcaggcagatcacgaggtcaggagatcgagaccatcctggctaacacggtgaaaccccgtctctactaaaaatacaaaaaaaatagccaggcgtggtggcaggcgcctgtagtcccagctgctcgggaggctgaggcaggagaatggtgtgaacccaggaggtggagcttgcagggagccgagatcgcgccactgcactccagcctgggcgacagagctagactccgtctcaaaaaaaaaaaaaaaaaaaaaccaaccaaacaaacaaaaagaacacaaaaattagctaagcgtagtggcacatgcctggagtctcagttactcgggaggctgagctgggaggttcacttgagcctggggggtttccttgagcctgggaggtcgaggctccagtgagccataattgtgccactgcattccagcctgggtaacagagcgagactctgtctcaaacaaataaataaaaagctgaaagaattcatcaccaacaaacacagtaagaaatgttagcggatgtccttcaggcagaagaaaaataccaaatggaaatcgggatctatacaaaggaatgaaaggcattgaaaatggtaactacatatatttatatgtgcctgtttttccttattatttaaatctctttaaaatataattgaggactgatatcagcaaaagggcagagtagacagctccaagctcccatcacccaacagaaacagaaaaaaaaaaaaaaaaaaaaaggccaggcgcagtggttcacacctataatcccagcactttgggaggccgaggcaggtggatcacctgaggtcaggagtttgagaccagactgaccaacatggtgaaaccccatctctactaaaaatacaaaattagccaagtgtggtggcacatgcctgtaatcccagctactcgggagggtgaggcaggagaatcgcttgaacggggaggcggaggttgcagtgagccgagatggcgccactgcactccagcctgggcaacaagagtgaaactctgtctcaaaaaaaaaaaaaccaaataattattagaaacaactctgaaaaacagccaaagccttacaacaaccaaatgaatgctgaatcaagaaaaaggcaacttaaaaaggaaaggtagaaaacctttgtggcaatgttttttaagagacaggatcttgctctgttgcccaggctggaatgcagtggcgtgattgtggctcactctacccttgaactcctgggctcaagtgattctctcacctcagccttccaagcagctgggactgcaggcgtgagccaccgcacctggcttctacgggagtcttgaagacagaaggctgcattcgcagtgtggggcctcttggcattccacagggacggggcggaccttaccttcaaattactggtaaatctgctatcgcacgtctgagggctactgagggaatgatgtagacgcctgtctatttgctggaaactcactgaggctggaaaagtggtgagcattgctcaaaaacattgcaaggcaaacaatctacacaggactggggcaaaacctgacagttgagactcacaacactccactgttctctctctttttttttttttttttgagactgagtctcactctgtcacccaggctggagtgcagtggcacaatctcagctcactgcaagctccacctcccaggttcatgccattctcctgcctcagcctcccgagtagctgagactataggcgcccgctgccacgcccggctaatttttttgtattttttaatagagacagggtttcaccgtgttagccaggatggtctcgatctcctgacctcgtgatccacccacccgcagactcccaaagttctgggattacaggtgtgagctaccatgcccggcaacagtaggggaaagagctgagttccattctctggtgtccttaaagaacaggaagaaatgccagagatggccaggcacggtggcttatgcctataatcccagcactttgggaggctgaggcaggcagatcgcctgaagttaggagttcgagaccagcctggccaacatggccaggcccgtctctactaaaaatacaaaaattagccaggcgtggtggcaggtgcctgtaatcccagctattagggaggctgaggcaggagaatcgcttgaacccgggaggtggaggttgagtgagccgagatcgtgccactgcactctagcctggagacagagcatgactccatctcaaaaaaacacaaaagaaacaagcagaaatgccagagacgtgcagagaaaaggtcacatgaagacacagcaagaaggcagctatctgcaagccaatgagagaacactctgaagaagtcagccctgctggcaccttgatctttgacttctggcctctagaattgtgagaaaataacttccagctgttgaagccatggtctgtggcattttgctatggtagcccgagcaaactaatagagacttcctaaatccgagaaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgggaaagcagggcagtcacaagcactcagttgttacacgggctttgcccagggcaggatgcttgctcagaaacacctgacaaagacctaagttttcaccttggcctgatcacgagggtcagtgcaggcctagctaagtgctgaaggaaagctgtggtgcaaaggcaaacttcaaagactgggagaggtactttcttccatttttagctcctagtattcaaggaaatctcttaccaaaatgtgagctgaacacatgctaaaagaatcagagacttcagtgaccacacatgaaaatgataaatctttgcaaaaatagtttggaagtcactaaacgtatgtactactacagccttcaatgattaaaaacagacacactcacaaatacatagcaaataaaattagaagaatcatctaaatgccagagttactaccttgcaatattcaaatgtccgtgtttcaatgacaatcgcaaatcatgcaaagacaagggaacgtattcaaagtaacaaaataaattgatggaaatcagcccttaggaagcccagatattggacttagcagacaaagactttttaaaaactctataaatcgtgaaggacctcttcaaggagaactacaaaccactgctcaaggaaataagagagtacacaaacaaatggaaacacattccatgctcatggataggaagaatcaatattgtgaaaatggctatactacccaaagtaatttacagattcaatgctattcccaacaagctactgactgtcttcacagaattagaaaaaactactttaaatttcatatgaaaccaaaaatgagcccatatagccaagacgatactaagcaaaaagaacaaaggtggaggcataacgctacctgacttcaaactacactacaaggctactgtaaccaaaacagcatggtactggtaccaaaacagatatatagcaatggaacagaacagagacctcagaaataacaccacacatctacaaccatctgatcttcgacaaacctgacaaaaacaagcaatggggaaaggattctctatttaatggtgctgggaagactggctagccatatacagaaaactgaaactggaccccttccttaacaccttataaaaaattaactcaagatggattaaagacttaaatgtaaaatccaaaaccataaaaatcctagaagaaaacctacgcaataccattcaggacataggcatgggcaaagtcttcatgactagaacaccaaaagcaattgcaacaaaagccaaaattgacaaatgggatctaattaaactaaagagcttctgcatagcaaaagaaactagcatccaagtgaacaggcagcctacagaacgagagaaaatttttgcaatctacccatctgacaaaggtcagatccagaatcttgtatattcttgtagatccagaaactacaaggaacttaaacaaatttaccagaaaaaaccaattaaccccatcaaaaagtgggcaaagcgccaggcacgatggctcacgtctgtaatcacagcactttgggaggccaaggcaggtggatcacctgagctcaggagttcaagactaaaaatacaaaaattactgaattactctactaaaaatataaaaattagcctggcatggtggtgggcacctataatctcagctacttgggaggctgaggcaggagaatctcttgaacccaggaggcggaggttgtagtaggctgagatcgcgctgctgcactccagcctgggtgacagagtgagagtccgcctcaaaaaacaaaaaggctgggtgcagtggctcacacctgtaatcccagtgctttgggaggccaaggcaggcggatcacctgaggtcaggagttcaagaccagcctggccaacatggggaaatcccatctctactaaaaatacaaaaaatttagctgggtgtagtggtgcacacctgtaatcccagctactagggaggatgaggcagaagaatcacttgaacctgggaggtgggaggcggaggaggagccgagatcgtgccacttgcctaggcgagtgagactcatctcaaaaacaaacaaaaaaacagtgcatgttggctagtttgttaatcaatattagttagttattagctccgaatagatgtcaggtaatatggtaggcactgatgacgtattcatgacacaaagctggtcccaatgctagaatgatctttgttcgagatccaggttgctgctgccactagagggcagccgaagctcatctgtaatggcacagtaatggttaaccccaacaatctaacattaccagggaagaactgtcctgaagggcaaagtaccaagctacctaaagtttgtattgattctctcaagactattgctaacaaaatggtaaaatgggtcaagtttgtgtttggaacccctagcctctcatctcttcaccctcttccctgaagaggtggagagaataatacaggtaccacctgtaagtaaaaagtgtggcagaaacagtcagttgcatctctcaccaacaggtgggtcggggggggagggagaggagattcctggagaggaacggatcaagctaggaagcacagaactgcaggccagagacaactctggaagcagaaacaggtgtgtgcttccaggcgcacagacaccaactgtgtgacacccacaccttctactcacaaactcactattgacagtgcaccaccacctgctttgtgcaacacaggaaacaccaataaacactggagacagtgtcaggccaggcatggtggctcacacctgtgctcccagcactttgggaggctgaggtaggaggatcgcttgaggccagaagttcaagaccatcctcagcaatacagagagaccctatctctacaaaaagtttaaaaaaaaaaaaaaaaagatacaggccaggcgtggtggctcacgcctataatctcagcactttgggaggctgaggcaggcggatcacctgaggtccggagtttgagaccagcctaaccaacatggagaaaccccaactctgctaaaaatacaaaattagctgggcatagtggcgcatgcctgtaatctcagctgcttgggaggctgaggcaggagaatcgcttgaacccgggaggcagaggttgtggtgagccgagatcatgccatcgcactccagcctgggcaacaagagcaaaactcggactcaaaaaaaaaaaaaaaaaaaaaaagacacagtctcattccttaatgagtataaagaagtaaagtgtttcagttactaattgcataagaaaccaatctaaaacatagtggcaaaaaacaatcattatcatcagggattctgtgattccaacaggcctggcttgtctctggtccacacgacatgtggggcctcagctgggaagacatggagtcttaagtgtgatcaatgggagggggctggaatcatttagaggcatcttcattcacaaaaccaggagctgatactggctgtcagccaggacttcaactgacctgtgggctggaacctgtccatgtggcccctcgcaatctccccatttgggctggtttgggcttcatcacagtccagcagcttacttctaagtgcaagcattccatgacaacacagcagaaaggcatgacatttttacagtgcagcctggctatctcatagcgtcgcttctgtcctactttatttattggtcagggcaatcacaaagatgtgcataggctcaaggaaaagagacatacccccgaccacgcgatggaagaagtgacaaggtcatgttatgagaggagtgtgtgggatgggagatagggctgtggccacctgcagaaaatagcatctgccacaggctgtcatggaagcgcaggatggggatttagcctacctgaggggtcagtcagcaaaggcctctgggacgaagtgagatcttcggctgaggatgtgaggggctaaaaggagactgaggaagagtttcagggagaggaatcaatgagactggattccagagagaggctggtgagttggatggtttgcttcaatatgatggcaatacagagggcaaggagactggtgcaggaggagagagaaggtgccatgtgctctgggtggcgctctgtgccggacccccttagaagaggagcagcctccagtcagcggtgtcccaggaacacagaggctggagaggacaatggcagccaatccctgctcccaatctggtgacagtagggaaaagctgcatggtctagatccaccctgctccctggccccagtatagaagatcaaattcaatctgcccaatcttatccagataaagtaaaggaagactggaaaaaagaactaatccaaagctccatctgcccatgattttctctgctgatgccggaggcagctatggataaagagatggcacacggcatgtcccgacgcagtggaggtggggagaccctgcaactccacagggaaggagtgaagttgctgccacctgggcatcagctattctctgctcttctgcctcatcctcaattcagaccatgatggagctgattttcctccattttataccttggattgaatggtctcgagctgctggtcttgtctccagagtcacatccaagaggtttgtctttcaaataaatgctgtgtatcaatgtacagtgtatataattaatgtatgatatcagactaaattatagataagacaagagatgaaattagagttaagtagggacccgatgacgaagagccttgtaaatcagggagagtctggttcatgtgcttctccagacacaatttcaacacggctgtaagcatgtaccactgatgacacggacactgaattacccgccgtgctggtctgtggctctcaagttttgctcattctgcttctgcgggaaatgccttgacgcaccttgggaaaactcacttagacctttttttgagatggagtctcgctctgtcgccaggctggagtacagtggcgcgatctcggctcactgcaacttctgcctcccaggttcaagcgattcccctgcctcagtctcccaagtagctgggactacaggcatgcaccaccatgcccggctaattttgtgtgtgtattttagtggagatggggtttcaccatgttggccaggatggtctcgatctcctgacttcatgatccgcccgctttggcctcccaaagtgctgggattacaggtgcgagccaccgcaccgggccagaaaacccacttatcttttaagattcagcccaactgtcaccacctctgggaacctgtcctcagccccaaacatatggccaccctccctttggggtccccgctcgcccgtgtctattttcattacattcctatcagtttactgcactgtgctgcatatctaccgtgtctattttcattgcattcctatcagtttactgcactgtgctgtgtgtctatttctcccactctggcctgtgggctctttgaagacatgggctgtatctcgcctatcttttgatccctcacataggatatggtgcgtggcgagcactcactaaaggtgtgcagagtactgcatgaggaaaaacttcatccaggccaggcgcagtggctcatgcctgtactcccagcactttgggaggccaaagagggaggactgcttgagcccaagagttcaagattagcctgggcaacatagcagagatctcgtctgtaccaaaacaacaacaacaactagctgggcatggtggcgtgaacctgtagtcccagctactcaggaggctgaggcaggaggatcccttgaacccaggaagtcaacgctgcagtgaggtatgatcgctccactgcactccagcctgggtgacagagtgcaaccctgctcttaaaaaaataggaagttcatttataaacagaagtgaacaggaatctgactcttgtactttggtgggagtttgggttatcttttacttgaggctgaggctatgccaaaactagggatgtaataacaagcaccatgtaccgagtgctgcttctgtgccacaggctctcctacatgcttgccacacattcgtctatttcatcctcccaatagtcctactccatgtccagcaaggagtgaaaaggctgaggcgagtcacagggagaagagggccccagtgaacagacgaaatgaggaagaagatctggagaggtcgcacgagccagagcgcaaaggcacagtggctgcggtgcaggctctttagcaaggtgctttgggctggagatggggttttactgcctgttgcgagatgggacatgagacacaatcaacatgcaaacgggtaggatgtttcatcacacggaagcaaaatgtattgccgctaaaatgagaagtaacaccctgaaggttatcaagacaacaattttcaatgccaaatgttgtttccagttccataggagatggaataagcacacccattacatttctcttctaattacaactaaaacccctgttcaaaatacatgaagcagctgggcacagtggctcatgcctgtaatcccagcactctgggaggccgaggcaggtgaatcacctgaggtcaggagtttgagaccagcctggccaacatggtgaaacccgacctctactgctaatacaaacatgagctgggcatggtggcaggcgcctgtaatcccagctactcaggaggctgaggcaggagaactgcttgaacccaggaggtggagactgtattgagctaagattgcaccactgcactccagcctgggcaacagagccagactatctcaattaaaaataaataaataaataaataaataaataaataaataaatacatgaagcaacaatccaatcaatcaaaccaacaaattctggaaaggtagagaagagaagggctgacccagtggtgagttcccagggtggtttgatggtttgttctttggcctcctatataccctgtcttatctgttagagcggagtctacaaccaggaaatcccagtgcccccttcatcccccaacccccacaaaaggagcctcatctttcgagccaaatgacagcgaagagggcggccctgcgggacagtgcccttttgactacacacaccctactctaggaaaacagcctgaaaaaagctgcaccttcccctgccccagatactgtagacactgtggaacaaagacctgttgaccctccccaccttgggccaacacaagcagaggtggcatctctcccctctccaccaagcactggcaagactgtgtggaagggccctgctgaccatccacaacctgcacaagactgaaccacagtaacaaggtggcaccccatcctctctcaaagacagtgaggagctagaagcaaggattctccaacccatttcccgttccccgtcccacccaccgcagaatactcctctctaatcctaatataacgtcatgtacatttctgttacattcggattaaagacaagttctgtttaataataactccaagaacagttgatatatattttttttcttttagaacaggagtgaaagtttattaaaaagctttaaagcagtaaagaaaggaaggaagggaaggaaagtacacttggaagaaggccaaacccagttttcatattttattttcgcattgagaatcagtcagatttacttcagcctcaaaagtgtgtttatgtaaaattaaatgagcactagcagcaagctgcactttttttttcccaaatgggaaacgggttaaatatgtgtaggaagtcctgggccatgccctccaagtgcccatgtgtgaaaacaaccaggatcaacacagcaaaagctctgagagctcaacggcaatgtggaatactctgaggtttcaaactggcctccagggctgggtgcggtggctcatgcctgtaatcccaacactgtgggaggccgagatgggaggaacacttgagcccaggagttcaagatcagcctgggcaacagagtgagaccttgtctctactaaatataaaaaattagctgggcgtggtagtgtgtacctctggtcccagctactcaagaggctgaggaggaggagtgattgagtctgggagattacagctgcagtgagctatgactgggccattgcactccagccagggcaacagagcaagaccctgtctccaaacaacaacaaaaacaaaaacaaattggcctctgggttgcacaaaggtgggggaggccagaggagctctgcaaaaactttgaaaactaaattgatcttagaaccagagccctgctggccacagaaagtgcatcctgaatctaaacaggttgagtgcctgctaatacagaatatttaaacaggaactacagtctcataacataacactcaaagtgtccaggataaaattaaaacttactcctcatactaagaaccagaaaaattcgaacccagaaaaattactcctcatactaaaaaccagaaaaaatctgaatgaggaaagacaattaacactaagatgacaaagatgttggaattattgcatagggattttagatgagctatcttataaatggcccaagaagtaattatgaacactctcgaaacacactgaaaaatataacgtctcattgaagatatacggaagaactacattgtaattttagaactagaaattacaataactaagtaaaaaactcaatgggtgaactcaatagcagaatggagatacaacagagaaaaaaattagtgaccttgatgatagagcagcagaaatgattcaatctgtatcgtgacaatcttgccataagaaaaaaaattacgtagaaataatcccatttgaccaacagagagaaaacaaatagaaaaaaaaactgaacaatgagacagcagcaaaagctctaacattcatgtcactgaattcccagaaggagaggaaaaagagtgcagtgcccaaaaaacatctgaagaggccgggcgcggtggctcatgcctgtaatcccagcactttgggaagctgaggcaggaggatcacttgaggtcaggagctcaagaccagcctggtcaacatggtgaaaccccatctctactaaaaatataaaaattagccaggcatggtggtgcatgcctgcaatcccagctactcgggaggctgaggcaggagaatcacttgaaccagggaggtggaggttgcagtgagctgagatcacaccagtgcactccagcctgggcgatggagtgagactctgtctcaaaaaaaaaaaaaaaaaaaaaaaggaaatgaagaaaaatccagagagattttttttcagaagaaaaagtataaaaattaaattaaaaaagagaaatttaaaaaagcagtaagagggtaaatatctgggtgaatataatctcgagtttaaaaattatatttgatgggcaaaagcaaaaccataacattatctcagtggttctcaatgaatgtagaggtgatattcaagacaacaataccataaagaagggcagaggggcctagaaagcagtagagtttctacattccacttgaattggtaaaaggttgatactagccaatgatcataagtatgtataatataatctctacagccacctataaaatcctatacaaaaatatatactaaatggcatactgaattgatttagcacggcatatgaagttaaatggcatactaagaaatgtctaagtaccccataaaaaggcaagaaaagggaaacaggtataaaaaaacccagagggaacaagtagaaaatagataataaaaacccgtccaaaattaaatataaatcttctaaacacagcaatcaaaaaggttgttggaatctgtttttttaaaaatgactcatggccaagtgtggtagcttatgcctataatcccagcacgttagggggccgaggcggagggaatcacttgagctcaggagtttgagaccagcctgggcatgatagcgagaccccatctccacaaaaagaataagaaaaaaaaaagattagccaggcatggtggcacacacctatagtcccagctactcgggaggctgaggtgagagaatcactcaagcccaggaggtcaaggctgcagtgggccgtgactgcaccactgcactccagccaacagagtaagactctgtctcaataaataaataaatatcaatagtcacataagatggcagagtaggaagctgtagtgtagagatcagtcccttcactgaagcaaccactgagctagaaagagtgattggaatcagctcttttggaattctgaaacatgaccaggaactcctaacaaccagagacatacttaaacaatgaagagagaggctgctgatcttcacgagtgagtggcatgtgccaaccagccaacactcccccattcctgagcctgagttcccgaagcagctggctgatgccagggcgagcagcagaactctgtcctccaaaaccgtgggttctgcaccttggtgggtccaatgggtctctgaggaccagcccggatgcttgccttggtttatttggccctctcagcaacagtggcttccccagggacatccttcagaagattttattaaagagacaaaatcctcctctgccccaccccatttaaagccacctatttaaggaaatccatgttaggtggctggctgactgcagagataatgaaacaaatttcagtgaccacacaagcacaaggaagaaacactttgcaaaaatagtttggaaaagtaacaaaaggggagctccagacctcaacaagcaaaacccagcaatcccaggtgtctgagagaatcacattttgagggtcattacattgtaacacttaaaatgcaacgttctcaacaaaaaactacaaaatatacaaagaaacaggaaataggaagcttagaccattcacaggaaaaaaacagcaaagaaaatcagcaaacaatacaataactgaacaccatcatcgaccaatggaacctaactgacatttacaggagacttcacacaccaacagcagggtacacattctttgcccatggaagattcagcaagatttaccagaacctgggtcataaaacaaatgtttttctgagatggagtctctttctgtcacccaggctggagtgcagaggtgcaatcggcttactgcaacctccgcctcctgggttcaagcaattttcctgcctcagcttccaagtagctgggattacaggcatgcaccaccacgcctggctaatttttgtgtttttcagacggggttttgccatgttggccaggctggtctcaaactcctgacctcaggtgatctacctgcctcggcctcccaaagtgatgggattacaggtgtgagccaccatgcccggccaaaacaaatcttaagaaatgtaaaataactgaaatcatacaaaatatgttctgtgactgtaaaataattaaactaaatcaatttaaaaaagaaaccagaaaatctctaaacacatggaaattaaatacacttctaaataattcatgggtcaaagagtgagtcgcaagggaaactggaaaacatattgaattatgtaaaagtgaaaatataacatgttgactggtatcagcaaaaatggcagagtaggtatctccaagtccccatccccccacagaaacattgataaaccaagcaaaactgtctgaatcaacttcatgagaactgtagaaaaataatcaaaataatcaaaggtttacaataaccagatcatctgatgtggctctttgtccccaagcacatctcatcctgaattgtaatccccaggggtcaaggagggacctggtggaaggtgactggatcacgggcgcggtttgccctatgctgttctcgtgatagtgagggagttctcacgagatctgatggtttttaagtggcagtttcccctgcactctcccctctctcctgccagccagtgaagagggtacttgctttcttgttagctttccaccatgattgtaagtctcctgaggcctccccagccaagtggaactgtgagtcaattaaacctcctttctttataaattacccaggctcaggcagttctttccagcagtgtgaaaactgactaatactccaaatgaacactgaatcaagaaaaaagcaacttcaaaatggtaggaaaactgggttattttacttgcccttgccccacaaccttccatggttcagtgggaaccttgaagatggcagcccacattcccagcgtggtttctggtattgaaggcagcagagcagaccttattctcaaagcattgtgttttcctgttctcagctgcctgagggctgccaaaagaactgatacagggcagctgcctttgtttcacctaacccagaactcacacagggcagaaaagtggctacacagagggtattccttgaaaacactgtaaatcaaatgcataccctgctgatgcctaggcaaaagattacagttgaggcaaactataggtgtgctgacagcatgggagaagaagctgtggagagtttctatgggaaatttgggcactgaaattcggacctgcccatgtgtactatggaatttcagtagccatgcacatgctgagtgcagagcacattctcagaatagacctgagaaaggatgctgagctttcatctgtggctcctctccatcctccctgcaggcagggagtaaagcctagggcaaagctgtacacagactgggccgggtgcggtgcctcacgcctgtaatcccagcactttgggaggctgaggcgggtagatcacttgaggccaggagttcgagaccagcctggccaacatagtgaaaccccgtctctactaaaaaatacaaaagtaagccgggtgtggtggaaaattagccaggcgtggcggcacaagcctgtaatccctgctactcaggatgctcaggcagagaatcacttgaacctgggaggcagaggctgcagtgagccgagatcgtgccattgtacttcagcctaggcgacagggcaagactccacctcaaaaaaataaataaaaagttgtacacagactggctaagccctgaaggactgctccagtgccccagcacagtggcaatccacaaagacggaaagagctgggtttttctttttttttttttttttttacctttggcttctggcattcaagaaaatctctgttaaaacactagttgaacacaagctaacggcagagagactttcagagaccgcacatgtaaaagaagacacactttgcaaaaatgtttagaaagtcactgaacaaacagctacagcccacagcaaaagcaaacccaggggtggtggggaggataaaataatttccagttaccccattataatactcaaaatgtctgatttccttttttgagacggagtcttcgctctgtcatccagactggagggcagtggtgcgatctcggctcactgcaacctccacctccctggttcaagcaattcccctgcctcaacctcctgagtagctgggattataggcgcatgctaccgtgtctgactgtttttggatttttagtagagatgggatttcaccatgttggccagactggtcctgaacttctgacctcaggcaatctgcccacctcggcctcccaaaagtgctgggattacaggcgtgaggcaccacgcctggactctttttttctttttaattttactttttctttttttggggaaaagggattagaggtgtgagtcactgtgcctgactccaattttcaaaaaaaaattacaaaccatgcagtgacattaagagagtacagcccattcacaaaagaaacaaattgtctttaaggaagcacagacattgaaagtactagacaaagactttaaatcagctgtctgaaatctgctcaaaaagctaaaagaaacgatgaataaagagttaaaggatacaaggagaacaatgtctcaacaaatgcagaacatcaataaagaaatagaaaatattatagacaggtgaggggcagtggctcatgcctgtaattccagcactttgggaggctgaggtgggcagatcacctggggccaggatttgaagaccagcctcagcaacatggcgaaaccccctctctacaaaaaatgcaaacaatcagccaagtgtggtggcatgcgcctgtagtcccagccacttgggaggctgaggtgggagaattgcctgagcatgagaagtcaaggctgcagtgagccaagattgcaccactgcactccagcctgggtgacagagtgagaccctgtctcaaaaaaagaatttattatagacaaactaaagcttagagaaaaaaagaaaggaaaaaaatagaaattattgaaaggaatcaaagtctgaagctgaaaagtatacaaaaattagccaggcatggtggcgggcacctgtaatcccagctactcgagaggctgagacaggagaattgcttgaacccaggagacagaggttgcagtgagccaagatcgcaccattgcactccagcctgggtgacaagaacgaaactccatctcaaaaaaaaaaaaaaagaaaagtatagaaatggaaatgaaaaattcaccagactatttcgaattcattagagcagatggaagagagagtcactgaacacatgaagacaggtagatgaaactatcctgcctacagttcttttttttttttggatggagtttcactcttgttgcctaagctggcaagctggggtgcaatggcgtgatctcggctcattgaaacctctgcctaccgggttcaagcaattctcctgcactgtgccaggcccgactcaggctacttttttattttttttttgtagagatgggatctcactgtgttgccagactggtcttgaactcctggtctcaagcgatcctcctacctcagcctcccaaggtgctgggattacaggcatgagccaccacacccagtccacataccattttaaagtgttacaattcaggctgggcacggtggctcacgcttataatcccagcactttgggaggccaaggcgagcagatcacctgaggtcaggagttcaagaccagtctggccaacatggtgaaaccccaatctctactaaaaatacaaaagtagccgggcatggtggtgcatgcctgtaatcccagctacttgggaggctgaggcaggataattgtacaaacaaacagcccacaacaattctctaatggtgagggagtaaataagtgaccgataatgctggaggaagaggaagtgaatgggtccccagtataggttagaatgaaaaaatccctaccaatgtaaatcaaatataaaataaacaaaagagttcatgtatgtgtgcgggaaggaaagtgatatttgggggttgggaggtgtcactgagggtaccgagtacatataaacaactctttagtcactcccaaaggtctgggatgagcattttttaacatttgatactctactaacttacctggactatgttgacatggaaattcacctcccgttatccacagctcctctccctgctccaacttaatgatgacgtttggcttggtgatatcatatcttgttaatgggaaaagaagaaggacttgggcaagttgctcggcttcagaatctctgaagtacaagatgttgccacctcataagctgcataacagaaatgctccattttttaccttatcaaagatagaacctttcaatgaagaataatataaacactgcagctagtgcccacaaggaattaagtggtgttgtcacttatttcttcaaactcaagcataaaaccccattcaactgagagcattcagaaagcaagctatcctcacccaaggaaactagatggctgtagttctccaacatcacatccccgtatgttatcttctcatcagggtccagttgccgccactcctcctgggtgaaatccacagccacatctttgaatgacactggcccctgtaatggcaacatgatcagaattgggagatatggaaaagggatagggggataacattttacaaagctcactggtgaagttaaccatgaacatcgtataccttattttatgttacagattatggaagggaaatcatattggaaacacatatcctttggggtcctttatatatatacaaaaataaaaacccaaaacacccacctcggcctcccaaagtgctgggattacagcaatgaaccactgcacctggccaaaaaatttaaaaattttaaaaataaaataaaaaataaggccaggcacggtggctcatgcctgtaatcccagctctttgggaggctgaggcaggcggatcacgaggtcaggagtttgagaccatcctggctaacacggtgaaaccccatctcagttatgttatggagactggcttatgcacaaatctttctaatggttatatataaagcacttgaagtctctattattttataataggcaatacctagataaataatgaatttaactcaaaagagatggggtcaaattgtccctctttgcagacgacatgattgtatatctagaaaaccccattgtctcagcacaaaatctccttaagctgataagcaacttcagcaaagtctcaggatacaaaatcaacgtacaaaaatcacaagcattcttatacaccaacaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaaatggaagaacattccatgctcatgggtaggaagaatcaatatggtgaaaatggccatactgcccaaggtaatttacagattcaatgccatccccatcaagctaccgatgcctttcttcacagaattggaaaaaactactttaaagttcatatggaaccaaaaaagagcccgcatcgccaagtcaatcctgagccaaaagaacaaagctggaggcatcacactacctgacttcaaactatactacaatgctacagtaaccaaaacagcgtggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagagaaaaacaaacaaccccatcaaaaagcgggcgaaggacatgaacagacacttctcaaaagaagacatttatgcagccaaaaaacacatgaaaaaatgctcgtcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgcggcgattcctcagggatctagaactggaaataccatttgacccagccatcccattactgggtatatacccaaaggactagaaatcatgctgctataaagacacatgcacacgtatgtttattgcggcattattcacaatagcaaggacttggaaccaacccaaatgtccaacaatgatagactggattaagaaaatgtggcacatatacaccatggaatactatgcagcaataaaaaaggatgagttcatgtcctttgtagggacatggatgaaattggaaaacatcattctcagtaaactatcgcaagaacaaaaaaccaaacaatgcatattctcactcataggtgggaattgaacagtgagatcacatggacacaagaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataataaaaaaaaaagaatcttcaaacctaatgcctagaacattttatcaacattaaacttctatttaaagtttattcttagctatctataagaaacgtttacaggaagcagaaaagataagctctttctaagttaaaagagtatatttgcaaattgaactttcaaaaattgataaagcagtacacacatttatttttagaaattgaagctgcaaagctaagcaatttcctactatgacatgtgtgttggacagtgtagggcatagcaatgattagtgattttcagcagcctttcttgaataggcattgaaaatagctaaacaaaaaaagagaagtgagctgaattcttggagtgaatattttggagtgaattataaaacagagttcttgcaataatgcatgtaaattaaaaataggttagcaaagcatgagtaaaaatagtcaattttcaaatacttttcacagctctccgagtctgacatatttctctggctaaaagggaagaaacatatcggcactcatgttgggaagaccttagaacagcaaagtactaaaacttgccaaaccaacttcaagtggctttcttgttagtgcaatacacactgcactgagttcctgagcataatatttccaccctttcccatggagtctgcttaaatttgaagatttttttctggtaggtgtattgtccttaattttggaggaagttttaaaaaggtggattaatgttatatatgcttctgagaatattatgcaaccatgaagctttgcacttcaacataaatgaatcccaaaaagagccagatgaactgttggctgggaggcagagccttaggatgtttcaaattcattgtgacttcacataaaggtactctctggagtatgaaagtcaattttacaggtgtaaaataaaggaaaagaagacagtctgaaagtcaaatgaaattccaggaccacctgtatttcagtgaggtaagtgttataataaagtgttatgggtagatacataaaagacaactaatttagagtaaaaataaattgggggactattaagagactgtcttaacgtggaatgaattttacagagtctttatggtaacatttgtagataaaaattaggttagtaaagcataagtaaaaatagttaattttcaaatatttatcacagagctctctagtttacatttaataatatattctgttgcattggattgatatgcacaggattattttgtctccacgtaggggtaggaaagaaaacaaatttgttttgcaatagcccagtttaatagaggtggtacaaactttaggaagtattttaattttagttaaattgatccaggttaatttggagacagttatgaagcacatacaaattacaaatcataaaatggtaattgtatttgcagttgtaagaacccaaaagatttaagctccattagctaagaataaaatgctgataaccatgagtcgcagccatggtttggatgtactcagaaaagttaactacgtaaaaaatgtcaccttcttattcagcatattagctccctgggtgttttcaagacatatctgctggcttttcttttaaaattacacttcccttagctacgctgtgatattacagctatggaagagtgagctggcttcaccctgcctcatgcatcatcagccgaactgtcagtaaagtgctaattgcagaaactttattacttgaggtgatactgaaccagagagaacacagcttgatttttcataatctaaactttgcaatgtgagcaattagaaaaaaaaaaactttcctttttgtttcaatttctaagctaagcaaaattaaaatggatgtcattgacagtaaaatagaagcttaaaaatgttgtccttctaggtgactttataacttagtataaaatcccattaacccctttttataaaaatgcataatttgaagcttaacagcacttgcaattctatgacacatttggctacctgtaattggtgaaagacagaactttattttctgcttctgtcatttttgtattttttgtagaggaaatatacttcaaagatatgctttatatatactctctaaatttatatatttcctgtgggatctgaaatatttaaagcacctttaaacactatttcagaaaatgggtttgcaggtagcacaaggaatttcctctagaaatataaaaatagatgaggatggtttaatggaaaatttattggaatagacgcatggaatgttgggaccatttttagggcaaattccatggggagtgattagaaaaatcagcaaatataattccatgtgaaatccttggggaaattcagtatacaataaaacacatgagtgggatatctaaatcagacctaagggtctaaaaagaaaacaaacctatgatagcctcttaaggaggagaaataattagggacaagatggtagaaaaggcaaagaaaggaaaaatagttttctcagtgtaggaaacaatgtacaacatccttgggattatttctcctttttatggttgtaatgtagaaagactgaaagtcaataggagtaaattctactgattaagtgggtggtgtggattagaaggacactggcctataaagttaactgtgcaaaatcttgaaagggcttgcgagccacgctagagaatttcaaattgatcagaagggcaataggaaatcatatagggttttgcataggaatttaacatgagcagatttgtattttttaggggtcagtcttattgacatctggagagttgcctggagagagacaaggctgaaaatagggaaaccattaaaaaagctattacagcaatccacataggctatgatctaaggcacagctggggtggtagcagaaggaacagatgaatttgaaagatacttaggagataaaatcaacaggtaaatgactaggtgtgtgaggcaagagagacgggagattcagaaatggcacttgggtttccggtcaggacaacagaatggacggtaatgtaatttgctagaacacaggaaagagagtgggtttgggtaataaaggtgatttcagccatggacctgttaagatttcctatgagatttacatgaaattaatgtaagttgaatagtggatcacgaaatataagccagatggaaaggaagtaaaaagagaaagttgatgataggaggaaaggagaggggtcaagatttggaagtatccataaattacatggacaagtgtggaggagtaaccactagaggtccgagttggtaagagattatgctcagaaagtgggatgtctgcattcatgaattcagaagtagacatgtcctggtgaagacaagtgcacaggtggctgtgggagtggttggctgaagtggagttaaggtaagggtccttggaaatgaggcactagcagctcaactcagtgctggggtttcactttcctggagttcatgctgctatttcatttggaactcagatgcttttagggtactgagtatgttttcactaatatctgtaccttaatatttgtgcccatacacacagggggtcatgtataaaattctttggtgggtgattctgctgtatctaattatctcatggagaaaatggaacttactgaagaaaagaatggcagctcttctgcaaataaataagcagatacacataagcttgtaatacattactgttaaaaccagagaaaagaacctgctttataattaatttaattaacatattcaccactattggattcagtttaatttaataaaatttggtttaaaagtgctggcatagataaaactaaatgtttatataaacaagcatttgaacagctgagggaaaagattgatcgttgagggctaaaggtttaagagccttatagaagatggaacaattgatctgaaccttagaagatgggttaaaatctaaactagggaacctatactatatactaattatacatttaataggcttgggttcgaatcctgactctgcctctttctggctgtaagcccttcttcaaattaattaatctttctaaaaataaatgttctcatctgtaatataaaaatattaatagtcttacttataaaatataagtacatttaaaagcttttgtcctgtagtaattgactgaagtacaagcactaaaaatgttaatcatcaaaagcataaagattatataatatagaggttatatatagagaagaaattaatatattttaaaactgaacatttttgttgtgaaaaaaattataaaaaatttaaacagaattaaaaatgcatttattgtatcccaaatattggcaaatgatatcatcagaatataccagatggttgataccattagtgttgcccaataattgtttattttcatttatcagtacacagataattatgctttcctttctacttgaagttaggtgtggccagtgattggttctggccagtgaaatgtaagtagaaatatctccttcaataaagcacttaattacttgaccttaattctccaattctcttctgccatgcaaacctctaagcctggtgttaaaatggaattatcaaaaaatgtagaacattcaataacctggttgtttgagctccagatttctaattcacatgtgctgaccatgagcaagagccaaatgggcattgtttgttatgccacataatttaaactgtactaactgataccagttataaggttctctatctcaaatgagagaatagattgagagaaagccatgttatcttttatctaggcctgggcagacatatattaactgcgttgataaataaatatgtgtcagacacatattgataaatcaagaagaaaatagtaaagttaagatatataataaatggtaacataattttatcctcctaacaaatacatagacaatgatgtagttaacattatccatattaaatagtttatcatcttaaaaatcattttctaagtttttaatttcatgtgacacagatagcatttcctctttccatgttgcctcccttctaagagctatagtctgagaccaataatatagcataggttaagtatgaagcaaacaacctgttaaatatatcagggttctaggtatgatgaaacgcatgataaaaggcacaattaggagtgagaaacacatgatgaaataaacctaaatgctctttctacttggtgggtagcttgatgggttccccttccctgatagaatgaaaagtatttgttgagaaagtaaaacattattgacatttgaatacataacgggaaagggctaagacacaaaagggtgtttatggcaatcataggtaatgtctcaactcaaaatgtggagaaggttaccgtagtgaagtcttcaaactgtcatctaggtatctaggaaccacaggcagtaaggattgcgtctggatgttactgtgcctctgatgataccactgccatttcagtagagtggatctccatgtcaagtggatctatgctaagagtccttggcacagatttctgatcccttcaatcctgaagaattggcatgaatagttccattttgctttgtggcaatagttctgactctgaagtcaaccctaatcacgaaatatctctgtgaattgaaagtgaacaagagatgtcaatgaaaattctcagtgcttctcagaactgtaaggcctccaaagaagtgtaaatttaggaaggctatgcagaaaatggcaggaggatgacggttcattctccaccctatagcagaagtgatctttgaaatgttggtctgctcatattatttccactgttacttaaaacccttcaatggctttccattcctcttaaattgatggccatgaagaacttcaagataaaaagataaaatgacccaaaagacaataaatgatgtgaacactgtctacctttccagctcttctcttattatttccttatcatttccttccctggagccatcactctagatcagccatgcttcctcccaccatgaagatcttacacatgcaattatctctaccaagatgtttttccttcccttcccttcttagtagttcacactgcttatctctcagccacatgtcagctatcatttcttatggagtcttatattactccttggctaagtcacatcctcctgcaacagggttttgtaccactgaggacctcccctttgtggtcattgtcagaattgaaatttaataattgtgtaggcataattcattgatggatatttgttgttatacatatttttttattttgctagaaggtaaacactacaaaaacaagaggatatataggtttccatttagcttcttttgccagtgtttgctgaagggtcaaacaagtggcagattttgaatacatattggttgaataaattaatattgttgaacactacgatgataccctaatgaacagatgtgccttctgactcacttaaatgcttaaaataaaagtcaaggtattttggagggtgtagatgacacagacatccttcaaaatgttgcagttcactattcagagaaaaatgtggaatctgatgttagtcttttaagttgagggaaggagagtaaactgtcaaagcagtgcttgtcatgggaattttttctttgccacggttcataaatgaaaggtaaggaatgagtcaccatgttgatagtgcattcaacctctcagatactctgcaaaaaggattttatacattctggcttaattaggatccttaggtaatatcttagtctaaaaaactaaatacagtggttaactaggtcctctgtatatttcagtcagtattgcagattatattttggagaagtcttagtactttttcttgccttagaaagcaccatggtagtggacatcacggaaccttttccaatgattcagaacactgtgatgcctcatggttgtcatcttgtaaatcagttattatgggaaatagaaatataaatttagaagatagagcagattgaaccaaatgacccttggatataacttgaaaaaagttctgtttaaaaccttccaggagcttccaacacttagaatgatatcccagcctttaccagtgcccagtaccctggaatctggttcctccctgtccatccaaactaccttcctgctgttcccacacctgccaaattccatccctctttctggaaaaatctcccactagaacttgagaagcttcagtcacatcatttagatttctgcttgatagcttctcctcagagaggctttccttgagatcctgtggaaaataccatagtagacaacctggtcactgtctatcacatgagcctactttattttctttataacccttactacttattgaaattatattatttagggtgtgtgtgtgtgtgtgtgtgtgtgtgtgtgtgtgttttaatttttattgttcatctcctggactaaaatatatgctcaaagagtaacaatatttactctattctctgttttatccccagtgcttagaagaacatatggcccagattccacactcagtatataattcttgaatgaaaaagagaaatgaatcaagggcctctgattccatgaagccctccccaactgcccaccacccatgacatacatcacttaagcagattgatcattcctctcctatcccattaacagtttacatttcttgggcaggcagtgtctaagacctttatatatgttgtctgatattatttgtcaggctgtcagactgcctgattctgaccaaggagaacagaaaaacaggtaaattttagtctcacgagggtctttagaacatatattaaccatgcattcatgtaagcatttataaacagccttacaagtagaagaattccaagagtacccttttggaatttagacataaaacattataatgccttttggaacagctaaagtcaggtaacacccaattccatactggttgtgtgagtgtgtgtgtgtgtgtgtgtgtgtaattgtttgtggacatgcagatgaaatacaacttgatttattaaataactccagacctgtgtcataaatttcctttctacacttgcgccctttgaccctaatgtgccaaggttatacagtggagataaaagcaccaaggacttcatctgaatacatgaatatgcaaacaggcaaaaatatgccctatgcacctgaggaactacagggaaaatatgtctgctgtatttctcaggactttaattttcagagacatctctaggactagataggacaaaaagaattactggccaaactaaaacagctaagggcaaggcaaactgaagtgtagcatagccctccaatataaggcatctgagccaggtacttaacatgctatcaggattcttatagggatgtatgtgttaatttttctcagtccaaatcatttatgtccactgacaaatggggaataactgggcttaaaaatctgtaaaattaaatctaaaaatgatttttaaaataatagtattctgtccacaattcaacagcaacaattattttcatcagtctagcaaaagacaatttttttaaaggtactttaggtaaaattttcataaactattttggtttcaatgatgctgtattgataccatcgttggtttctgcaattatttaatctaattaacttgagttctccctaatgccttaaccaaaaatatgtattaagcatagtatatgtacagtattgaactaactttctgatataaataatactaaagaagtttggacaagagaaacatgttccctcttcaggacagggcatttcaaacaggtgaagaatcagagtttagtttgtttgtttccccagtccatcagagaccaatatttttgtaaagagaaaaaaaaagtgaattactacaaaaataaaataaaaaagacatccaaaatacaagtctaaattatttagtttttgatttatcagggataaaattacatttcaataaatataaccaaaacaacatttcataggaaaaagggaactatggaaactcttcaaattgttcatttaaaatgtgtatgtaggtagagaatcactattatgcccatattttttttcttttctcaattgtaactgaacaaacagttatatgtaaaacaattcccgtgccaaatacatttttgcacatcttgaatgaataccatggacatcaatatttaaagttttcaaaggtggcaaatgaacatatttcttacttcctcatttatctaatttaaattggattaatgaatttctaaattttgatcttcacttctgtacttattttatcacaaaccataacaaacagcaagaatgtaataagagaattagaccttccccacaaattcttgctgctgtggcctcttgaactctcttctctgtctcctcaattcagcaagaccttaaatctggtgctgccagttggaaaatgcttccacagagttagtgcctgtaattgtaggcctcactttgtttaatagccttctcgcatggatcatattcctgcactatctgttgaattcctgcaataaatgtctgaaaacatttgtttcatatttttccccctattccctagttgtttaagaaggaaaggtaaattcagcttgactaggagcagaagttccatatcttgcatacattctacactgttatattttcattataaatcacaccaaaatattttctactttgcttgattttttttacttaaaccttgaaatactaagaaatgtattatttaatattatgcagttgggaagtttctaattttatttttattattgacttctagattaatttcttctcatagcataactgagtaacttcaatccttagatattgttgaagctacctttttggcctagcatatggttaaatttcatacatgtatacttaatatataccttgctttccgcaggtgttgtgttttctatatatcgattagttcatgtttaaaaatttaattattcgtaccatctcattttttgttttgccagttctatcagttatagagagaagagtgttaaataattgcagatttagaccaggcacggtggctcacgcctgtaatcccagcactttgggaggccgaggcgggtggatcacgaggtcgggagattgagaccatcctggctaacacggtgaaaccccgtctctactaaaaatacaaaaaattagccgggcgtggtggcaggcgcctgtagtcccagctacttgggaggctgaggcaggagaatggcgtgaacccgggaggcggagcttgcagtgagctgagatcacactgctgcactccagcctgggcgacaaagtgagactccgtctcaaaaaaaaaaaattgcagatttattcttttcttttttaggttctgtagtatgtagctatggtagtggatgaatacccatttggtattgtgctatcttcctattggatagactctatattttaaaatgtccctcttatctctagtcattgtcttactttgacttacattaattagcacagcagaactagctctctgttggttagtgattatcatgctttcttccattatttcactttcaaccattctgcattcttatatttaaagtgtattcttataaacaatatatagttgttgttttatatcttaaacataattgttttttccttaataaatttgatctattttcatttaaaataataatggatagagctgtgattatgtctgctatcctgcaaagtccctttttaactgctttcttgatgacttttgattttgtcaaatattgtgagaacgtttttcttatattaactcattaactacaactactttgtagtgattaccctagagagtatataactcattctatacttattacaatttaaaacaagctattatttatcactttcattatactacttgaaccatagaccttttaactccattactccccaacttcattttgcattcttattacttttacagtggacacatcttttaagattttgctgatgcataatgttggcttaaatatttcctgttgcctagttgaactaaacatatcatgatagtatttagtgaggaaatgtgtctgataccagaaattgaattcaatttattaaagatttcttggcatctgtcaaaaagttcatcaaaattttccgctttgcccgtgtaatatgattgattatggaaatctatttttgaataatgaaaaatatttgaatcttctcagagactatcacttaataatggtactttctgaatttaaagctctgatgaatttgacttactaatatctttcactttgtatctctctatctataacctaaatttgtctgtagattgctgtatctttttttgttctgtttatttaatatttattacaagcttgctaacagcatcatcctagcttaaaaaattaattagaaagtttctgttcttttctccgtgtcttggaagggattgaaaagcaaagaaattgtgtcttcttaaaagtttgcagcactgttcacaatagtcaaattatgaaatcaaccattaatgtgtccatcaaaggatgaataaataaagaaaacgtgataatatattcacaatggaatacaattcaacccttaaaaagggagaaagtcaatcatttgtgacaacatgaatggaattgaagaacattatgctaagtacaataacccaaacataaaaagacaaataccatatgttcttacttatatgtggaatctaaaacaactgaactcatggaagcagcgagtagaatgatagtaaccagaggctgggggtggggtagtggggaaatgatagtgaagcctcagtaaggaagaataactttgatttttttttgactaattgccaacatgatgaatatagctaataattaatttatatattacgatatcataacaagtaaatttctaatgttctcatcacaaaagaatattaagtatttgaggtgatggatatgtttattagcttaatttaaacttttcatattacattcaaaaattataatgccactttttacttcataaatatatacaactatagttcatcaatatatcataaaataatttttttaagtttgtagaaactcaactatgaaaccatctgggtcatgaaactatttgaacaatttctttattctgtataataacctaactttatgacaaaaagtttactatttcacttagtgtttaaatgtcttaagcacaatttcatgtatgtaattaatctgaaaaaacatttctatgacagtgattgtatcacctttcatacactaatattgtgaattactattctcacgcattttcccatgagtatcttttagagatttatctatttcattatagttcttaaataactagcattagatgtattttcatttctaacttcccttacttatgttattatctttacaacttcctttctactgatttcatagtgatcgaggcaggaggcagacagatgcccaggcagataggggcaggtcccaatgaaacccaatcttcaagttggaaactgttcctggtaaatccttggaccccattaagaacctgccttcctgtttcatgcactatcctctgaccttgatccccatccttcacgtattttacatatccctaccctttcttaattgtttttctacactgtagtgcccatctttgaatggtgttcttcactttgaccttttttgcatactcacaaacaaatcagcacacactccctattctgagctcataaaaagccccaggctccaccacattagaaaaccttcctgtcttcaggtaggagaaccaccccacccctcccgtgtcacctgtttttgctgagagcttttctttcccttaaattttactccactcactctttgaggtttgcgtgcctaatttttcctggtcatgagacaataacccaaaccgagctgagctaaaagagcaaacatcctaaatcaataggagttaattcagtgtactttcttatctccctgttaatatttattgctgcgaacaaactataggagattttgcagcttaaaacaacacccatttattagctcactgcaagtcagaagtttgcgtgacatcactggtttctcctctcagtgtatcatagggctaaactcaaggtgttggttatgctgagtcttctttggaagttctgaggaaaaatcagcctccaggatcattcttgtttgcaaaattcatttccttcctcttgtaggaatgaggtcctggtgttctttttgactgtcaacccagtagcttctctcagcttctagagtccccccacattccttgctatgtgacctctccgtcttcaagcctgcaacactgtattcaatcttcaagcctataacaatatgttcaatccttcctatgctttgaatctctgacttcttgtctcttacctctggacccagatttaaagagatgacatggttgagccaggcacaattttcctatcttaaggtcagctggttttagaccctaatttacactagcaaaatccttcacaacagcatctaaattggtatttgattgaataatgggaaaaggtgtgtgtttatcaacagacagaaatcttgggagtctcatagaattctgcctaccacatttctatgagtggcatatttagctcatttatttttattttccctattttgcaggcataaattttcagagtgcatatcatatttgtctgtgtttcctactttttgatatattctgtcttgagaagttgatatcctctttgactcaagagttctttaggttattatttttggttcctatgtgatttaatatgttccttaagtaatgcttttgttattaatgtttttatttcactgaaataagataagtagaattgttatgatttattcttttccttttgagtttttttaagacccaggatataatcaatatttaaaaatacctcatgagtatttgaaaatattttttaaaaatatatattttctgcctaggaactaaaacattaattatattattcaatttcttaatttcttcatttgatttctgattattttatcttcagaaagtttgaaaaataattattttcccatttattttttattttgaacatttaatatagttcagagatatattatttgtctcatagatgacttttgatagctaaatcttcatgttacagtacaccttttatcctcatataatacctgacaacatgctaaacaaagaattgctatgatgattataaatgatgatatttgtacaatatgatattgccactaatgcttttatttgtaattttctttatgtcacattatttttcattttgtatattatttagctatcagtcttcatgtattttcgttgttttttgttttgcaatctaattcccgagttttcaagtagtagggtttaacactttttttttttttcagttgggcttgcttctgttatctactatatattttatgctcttaagttttcatgctattccccagtcagttcactgattttgctatactattcaaagtttctttcgtttttgttttctagtgatttgagaataatatacctatgtttattctaccagtgatttatcttaaaattttgagcataaatgtatgaacatacatgaactcatttttaaatttattttcctctagcaatagagaatgatctttttaataaaataaaaccaataatctcattttcccacttaatgttctttctatttttgaagataaaagtcaaaattttagcttagacatgaaggcccttcattaactgagtgatgtctctttctcttgcgttgtaacttctgttctccttctctttagctatgttctgttgtttcaggattccgacattcacactgctgttatgcaaaatgctgtttttcaaactgaaatgcttgtgcttctcttttacctgctaaattctattcaaacttcaacattcagttcaaataattatgtcccctggaaaacttttcctagtcacattctccatgcaatctgattttaaaaaccctctccttcactgatgtggcactctgtagataccccatcacaggacctatcatcttgccctacattattaggttactcattcatcttctcttcttcttggagctcagtaagggcaggggctttgtcttattcagctttgagccctcagaatctagtgctgtccttcacatatttgtggtacttacaaatatttgtttactgaattaagtatattagacaaatatcaccagtgtttgcccatttttggctcaaatattcagaaatttcatttatgtttataaaatacacaatgtaattttctgatttattctgaagtaccagaaacaaagaaaaaatagaaaaccgaatatattataatgtaaccaatgaactttagctaacaatgtatcagtattggttcatcaattgtaataaatgtattatacaaatgcaagatattaataatagaggaaactggggtaggcaagtacatatgagaactttctgtactttctgctcaatttttctataggacaaaactgctctaaaagtagtcttataactaaaaacacctgtttatatatttcaaaatatattcaatattataactgaatataccttaccttactatttaataatagctcttttacatattaatttaactaacatattgaacacctctatgcccataagacaagtgagagaccaagtgttgcttgctacatattgtgataagccctgtcaagacagtattttttgagagcacgtaggaaacctatcaatcctagacctgggtaggtgatccaagattccatgatggaagtgacacctccaaggaagcctgaatgatgagaaggagtttatgagtaaagaactaaaaataaggaaaatagaacctggagaattaaatctgatcctgtttcagagtttgaactttaatccagaggtaatgtgatgccactgaaaagattgttaacatgtacatgacataatcagatttcctttctagaaggattactttggatgctacaaagaggaaagtggatgagaaataggcaagatcagatggtatcaaagcaaggagacaacttatgaagcttttttggccatctaggctaggaatgatgattctctaaaatggagtagtatcaataggaatagggtgatgagaatttcacagcagatcaggagatagatggattggatacaagtgagaaggaggcattcagggtgattcttcagtctttaactattcaactgggtggatgtcctcatgccattttcagagagagaaaagatagagagtaaatttgggtaaaggaattgaaaatgagttacatttgggatttgaaatatctgcagaatatgcaaatgaagacctccaactgagaaatgaatgtggagatcctggcctatgtaagggaattgggtcattaaaagacagtaagaattgtcagactatctcaataactgaagaaaggggtgtgggcaaattagcaactgaagcattggatattttccccactatagagatatagagaattattacttcggaaatacaacaacaacaaatattttctagttgagaaacttcatagatgtttataccatatttttctctttggtgataaagtgattttagaagtaatttatatttatttttaagttggcattacatctttttgaagataccaggatatttactgtagaatctccaggctgccatccatataatggatcccaaggaccttatcactttcttgacagtaagaatgtgtgtactttaatgaagttgttatcaattccatcagatgtaatacttactttgataataaataatgtggaatgctccctctactatcctgaaattaaatatacacataatacctacacagataattaaaaaatacagtgccctaaatgtagtataaaggaggagtaaagacaactaataaagttaatatttctctaaaaaactgctcaacgtaacagcactagaagacataatgaaataatcagatacttaaacccctaggtgtaattacaatgaagttgtagctataagtgaaggttatgtaaacttcagaaagccatgtgtttattctacttagttcactgctatttcctttgtacctggagctatgcctgaaacatggtatgtgctcagtaaaaactttattaaataattgaaataataaattcaagtgttccttatgattttaaataccactagcagcactgctgtcagtgatgtgatgtttcaaaatgtggatcaattctcagtgaatttccaagcaatagtttgcccagttgttgcatttaagtattattactggtttaattgtaaattgttaagtactaatccatgagaataatcactaatctgaacaaatttctttaaaatagcttactattaagtactttacttaaatcagcaataatgaatttgcactaattggtcacctattatgtacctgatagtagagattgtgctctcacacctgtatatctttacccttggagaggcatttactacataatttttgagtaaatgatttcttgcaacaattctgctttgtgagtgttttgccacttttaaaaaattgtctttctgattgctatgtttaagatttgattactatgttctattactgatatttgaagtaacttaacagaactatctggtttatttatctacaaaaatatatattttacccagcaatttaagactatgtttaactcatcattatttcaataagaaatgaaaaatacattaaacttatatttatcatagtcagttccctgcccatttccctttgggtcctttatctcttctatgagtggcagtctgactccccacccatactgccatctgtactggaaggctgtcctctgtttccagaaccttctttgccaatgcacagctgaccagaaatgtctgggggctagcatgtctctgagagcctttgccagtgggtttaataccctaggttgctcatcttggcaagaataatcctgaggcatgtcttttcaccttttctcagagctgacctggggattgtgctccagaacaacttgacggcctgcttttcccttcctgtatcatctccacagtcctctgcttgtttttcctgcagctcccaaataaacaaagggtgtatcatccttttctcagggtctgattctcttagggtcacctaattaaaggagttagaaattgttctaggaaacagatcctcagagagaactttggggttgggtcttggggctggccagatagcaaaagactgcattgctggtggtagtcgggataatgataatctttgacattctatagcataaccattaatgcccttttcaccagtggtgaaatgaaatggaatatctgtggaagaggatgcaatatcactgatatttaagaggtatggtggcaacggtcattacagactgtggaattctttcgttgttttaaaattctattaataagcgaaattaaaatgctgacaggctcaaatccgaaaacagataccttttcccggtggggtgggaggggccaaaggggatctttgacagtatttaaagattccttcatctcctgcaactagagggcagatcaggacaaaaactagacccagcacctaattgtgagagtaggtgagttacagagaaggcatgattcctagtacttatgtctcctctgctgaataaagggcctaggtgcaaaaagaatgtgccctggctacctgggaggggaatatctgagcagacacacttgagaatacttaatcccccattcccttgaatcctccaaggctgcagaagaggtctgcttctcttgcctggagaccttgcagaggcctctgctgagatggatgcttcccccaagttgataatggaattttccaagatttccctccacttcccctcatcatttctagactaatagctggtataaagtttagtaaattacctcctctgggaagaaagggattcttccatccctcaccccctcaaaaaaaaaactatagttcttgcaaatatgtactgacagggccccaggaatgagttttgagggcactagatgaatggagggaaggtgttgagtggcatgcagaatataaagctatacaggggagagtttgtaaatataagaaacaatctaatggtacagtatgcaacatactgacaaggacacctggagcttgttctaatttgctactaaaatggctccctgaagcttggggaaaaaaatgctggcctctaataaatggatggagatgctgaaatgccttggcagaatagtgtggaagaattaaaaatccttagagaggtaggcgtgctagaatgaatttattcactatctgacctatttctcaatgagagcccagaggactctccacttagtaaatcaatatgggatgagctagtaaggatggcaccaacactgtgtcctttctaagccagggtcgatggaggggacactgctttggaactggactccccagagtcaatgaggacaataggattcaggcacagcagaaccctgaggctggcattaaacattaaagaaaaattgtaagtagctaccaaagtgtagcaaagctgcaatggcaaacacatttgtattttgcagcatctaattatgatttttacgtaaaacttaatacaaacctacctacattcattatcataaacttaactgcatatcagtatcttaaaataatcttcccatattaaatgtttgtgaaaaagaaatcaattctagtcatcagagagcccttgtaataaatatgcaagaaaaacaaattattgacatttcctggaaaggtgaacattaattttgttatacaaatttcatgactgaatatttagtattgatctttccaggccagagtttttttcaactttatttttatcttcaaatttttactttctttaacatgtgtcttcatgatattgaagcagcgtcatttgtctggggtgatacagaggttcgttgtctcatggccacagaaaactaggacatggacacgcgaagagtgaggttcagagcagaagtttaataggcaaaagaaagagaagagctctcttctgggttaaatgcagcaggttttatagatgatcctgaggagacagtgtctgatttacatagggcacaaaagattggttggaccaggtatgtcatttgcatagggcacaaaaaactaattaggactaggtgtgccatttgcatatggcgcaaaaagctggccacccccaccctgatcttttattatgcagacggattttctaccttgccagcgccatgttgcctgtttgtttactgtacacctggtgacaaagaaaagggaagatagagcctccatgttgaacctacctggcccccaggtagctcttttctattggcacagctgctggcattcacccatgcaagcttccagcttgcttatctatgtctgcagctcaatttttcaggctgctctttgttagaaaagaaatgatttgggggctgctttttgttaaaaagggaaactgcaccaaggactcttgcccttactatctgcctaaacagtttatttctatctcctgtatcaatattccatgcttctctgatagaaaaaagtatgtatgcatgtgagtatgagatgttaccactgttcactaacaggactgaagatattaccactgttcactaacaggagtaaattgatttatattctagtaagaaacgcatataacaaaccatcccagtccctttttgggtatttcttgcctaggagccactttatgccaagagaagtgatttattggcattatagtgttaaatattcccccattctgcttaagtggccgtatttaaatgaagtttaagtactccagaacctgtggaagcattagcagtcaagtgggccagtgctttctatttttcagtgtgtgtatttgggtagtagatggcatgcatttgtacttatgtgtgagtcttcctgtgtattctagtgttctcaaggcataacaaggtacacattttatcaggtttacttaatatttttggctggtagaccccctattaaggtgattattttcattttaaaattaatataaatttattttgggaaatccaaaaatatatcttgtttaaaaatatcacgaacatctttgcctctttatagtaatccaagtgtgttttaactcacttctttgtttatttgttgtatttatatatttgctttttatagtgattatgcaactccaaacccttccttttcatttatgaaaatgatatatatatatatatttttccaagagctagcgtctcttatataatatttaatggcattataaaagctcaccgaatgtatatactataattacttagccatgattctatcataaacagagattctgtatcagtcagggttctccagagaaagagaaccaatatagatatatagagagatacagatatagaaacagatttataaagagattaatcatgaggaatttgcttacttgattttggagactgagaagtcccatgatctgccctctgcaagctggtgactgaggaaagccagtgagttagttctaatctgagtccaaaggcctgagaaccaggaggctgatggtataagttctaatccaagtccaatgtctgagaactggggagaagatggtataagtttcagctcaaaggcaggagaatatggatgttctagcccatccagtcagggagagagagtgaattctccatttctctgccttttttcttctattcaagccttcaacagattgaatgcttcccacccacgttgggaagggagatcttctttccccagtctattgattcaaatgctcacctcatccaaaaacaggtatttgtttaaccaaacatctgtgcaccccttgacccaatcaagttgacacataacattaatatcacaggacacaatcctactgattgttcagaattattctgtcatcagtatttgtgcttattttatctttttgttcatgtttcagagtttataattaatttcttataatagatttccagatatggaattaccagatcaaattgcataattaactttaaattttcagctgggcacagttgctcttgcctgtaatcccagcactttggaaggctgaggcaggaggatcacttaagcccagaagtcggaagaccagcctgggcaacatagggattctctgttgctacagaaaactttctagaaattagctgggcgtagtggcacacacttgtggtctcaactacttaggaggctgagatgggtgaactcatgagcctgggaggttgaggatgcagtgagttgtgattgtgccattgcactctagcctgggcaacagagtcagaccctgtgtcaaaagaaaaatcataattgtctcaaattatttctggaataattttatcatactatatttgaccacacatttattattatgtacgatttcatatgcttaattttaatagaataaaaatttatatttcattttccccatgtgcttattaacgatttatatgttctctttctttaaacatcagatcatattccttggccacttatctattggaattataggattttttgattgatttctgaagtcttcatttattaatattgttactattaataatattgatatttcatctaatgtgacctacttaattgtattaactttgtattctttttgaacaaggttctaacttgatgtaccaaaaatccatttttactgtaatatacttaaaatgataaccatctcattatcttgtgatttaatgaattattatttttatttctccctgaattcatgtttgaatgtttgcatctcatatcttattttggaataatatatgagttgagtatataaattcattattttctaaatagcaaactgattaccaaaacagttttattaaataatctgtctccttctcactggtttgtgatacctctatgactgtagtagttctcatggaagataaggtctaattcttataaatatgttttgtagtgttcatcgaggtctatctaattttgttagtaccatgttcacttaagtattatagttttataacatttgatgtctattatgtcttgctcctcattttaattttttgaaaactagctctcctcatatgatttaacatatggaatttgaaattttaatttccagtttttcaaaaattatttcttttatttataatgaaattacattaaataaataaaataatttagcatgaagatatatttaaatatacatccctcttgcttgaagcatggtgtatctatccaacttcttaagtctgctttaattctctctatatttggtagttttcattaaatatacactagacgtgtttcattgaggttacttttaggtattttgttaccacaaatgggaatgcaattataggcaaagcaagcagaaacatacggctttgatgaaagctctaatctcaacactgtccatatatatttgaccacatcattagacctataaaagtttgcattcaggcaatactccagattttatttgatctcatttcttgttttgagccatctggcaagtattcacaattattgatggcaagaatttctcaaactggatcaataaaatgtcttccttcctaaatcccagtggaatacactgaggactgtggggaagctgatttacttaaagattccgacagttctgtagaggaagtaagaatggaggaactaaaagctctgtcacaggctcactgttccatctatactttcccttcctcatctcattctcaccctgagcaccaaccaccatatgatgtagctgctgtccaaatataaatttctagtccaggtcctctgatgaaccatagcataaatatatcttcactcagacaagctcaatttgtccaaaactgaactcaaaataattttgctcaagtaggttacttctgcattctatatgggcaatggcactactatccccccagctggttatgcctaaaagagactatcttagttttttgttcctttttatttccccaagagtgtagtctccacgtctccttaacatctccttagtgcagaacctcctctgcatcctatctgctactgccttggtttagggccccgttttccctctcccaggcctgagcaatagtttccccacacttcctcctctatagtcagctactcccaccatctatccttcccactttagacaaagggaactttctaagaagcaaatcattgttgttgactttttctcccttccaaaatacttcaatggctcattattaacttaaggagaaaaagtattctatttacctggacaactatataatatcttgcgtattactcatcctgctaagtaacccttagttaagtgaaagcatttgcattgctaaggtagtaacaggaaacagagtgaaagaaaatagtctgccgagcctggtggctcatgcctgtaatcccagcactttgggaggctgaggcaggtggatcacaaggtcaagagatcgagaccatcctggccaacatggtgaaaccccatctctactgaaaatacaaaaattagctgcaagtggtgcgggcactacttgggaagctgaggcaggagaatagtttgaatccaggaggcagagactgcagtgagccaagatggcgccactgcactccagcctggcaacagaacgagattccatctcaaacaaaacaaaacaaaacaaacaaataaaatagtcaataatcaggcattgaacattcagctaggaaacctgagggaatcagcacagtttataccagaatccagctcccactccgggagagataagaagaagactactactgaggcttaggacagtgtagaggaatgaggaaaagcgacctaaaattttcgtgtctgggagaagagggaatgagcagtggctgaggggagcaggaggtcagcatggagagaaataaggagacagttttggtggccagctcaggggctgtgtgaaatcattgaatgggagtctcaccaatggcagaagccaagccaatgcctgatttttgtgcttaccttcaaactgcctgttcctcttcttcctgtcttcagtggttttccatcaacagcatgccatttgtggttcattcagaaaaatggcattctggccccatgactttgcttactttttatacaggccacttggcatggccattctccagtcccttttaatggtccaaaacatttagaagactaagaaacagagagtgaagtgaaattaagtcctgaaagagccttgtgtatcagggaaatcctcagcactcctacttggagggacggcactgcgattaaagcacttcagtgacatgtgcatacacttagctctccaatgtgacctgttcctgtgacctcccttgcttcaacctagtcacctgttctagttacccgtagatacaccaggtggtgggaaactttgacaacttcaccagcactcttccttctactgagaaactcccttccctatcccacataattttccagtgcacacgttaatcttgcaagatcatatctttttaaaaagtgtctgtctcttaccttgtcatacacatgtaaataaaaaggtgcaacaaagtttttgggtattgaccctccccaccattccacccacccacctccactcacctgtggctccagcctccggagcttatccatctctctattacaacaagtactccttcaagcaaatgttgaataaatgaatgaaaggacaaacaaataaatctgttctgtcaatccttaacagccagctgaaggcttaaatcagagaacttaaattgcccctgaaataatcactgcaatctgtactactcttcagacaattccctatttctgtcaacctacccctaactcaatatttaactgatttctaactttgtgtctcaactacgtgatgctttccaaaactagaattaccttggcagctaggtttacagacttcaaagaaacctgatgctgctatggatggaaatagggggcaagctggtttgtgtggtgagtgccaaggttaagtaaatagacatagtggagccaaacattcacctgcatttcaatatgatcagatttacacacacacacacacacacacacacactcttaaagttagcgatttatgctatgagaatgagaatattttagacttgaggaaactcaaatttaataaaacctgtaagatggctggctatgactttatgtaagctgaataaacatatcttcattcagactgatacttctgcctttcttctttgagtctctaatcatccaaagccaacttttcagttcctgaatgctacaaattatcttctatgaaagtcattgttttgtctatgaagcttatcataacttcagggaatttcacatttgcatttctgatggactacagtctaaggtgttagaaaattggtttcagctttccccacctttttttttttccactgtgaagcagctcattacaaaatagacacatttctaaatcaaatactcgagttattattgatgcatgtagagaatagagatgatttggttaagaaatgcctaaaagttaccttcttgttcccatgattttctagttgattgaatgatttatatgctcaattccaaatttaaatgtatggtttttaatcatcatgatatagttagtggaaggcttttaacctttacatttaagaagcccttagtacaactcaagcttattgacttctaaagcttaacatacaatatttttaaatgattcaagtctatacattttataggtctatagtttgagcaatagtagaagaatgtttaaagagccacttgttttccaattactgtattcatggctccaagataggcatgaatccccaccctaaaaacaaaacatgaaaaattggcatactttgagtagactacctctgtaaagtattaaaatctccaaacccaaagcgactctaagactcagtataattcatttattcgatggcactataatgggatttcttgcacagtgagaagcaagcaaatattatcttctttaagttcttaaatgttttatttagtatccctaaattaggaagggaaactaaacattcacataatcaaatatataggagggatctgtatattctgtattttttgaagttttttctactggcagatagcatctcattttgctgtgacgggcattaagactgtgattttgagatatggtcaaccaaaacttcatgcaactaattccatgcagatagcacctcattttgctgtgacgggcattaagactgtgattttgagatatggtcaaccaaaacttcatgcaactaattccagggtttatagcagaaaagaaattgttgtgtacctctcattacaactcttaactatttttaaggtagcttatatggttgacttagggaaaaggatgaagatccagaagaaaaatagtgagacttcaggtgatagagaaaaagagttacaaaatgttctaaaaggataaagcccaaaggctgtagagcaacacagtaatattaaatcctggattaaagtgaaatgatttaggagactttataagacatatctgcaaagcaatgcctttagaaatatttatttagtgagcctaattatgtaaaatactgagaattggtgacaaagtacaatattgtctcttcagatatatatttaacaaaattagggagttttgagttcgagcatttatcatcctactaaagcctttagcacatagttaattccatggcatgtattatcctgtcttccagagacaagtacaatgggattaaggaggatgaatggactgtctcacttagcctgggagattcaggtgaagtttgtgcacagacttgaaagaaatgcagaatttcctagggtaggcaggagatggggcttgcggtgagggaagtaaatttcagaaaaaatatcatgtgcaaaaaaggtacactggtatgagacagcatggtgtctttaaaaactgtagagcagtattccgatagcatttagtttaactccatcattatatttttaagctattttttgtactatacttctaaaacatgtttctatcctaagcgaacttacacaaacaccataacaaggcaaaatttggtgctaaagtataagccataacactacaaaggcaacgcatacaggagatttgatatgagtgttttgtacatatttcaattattagcacagggttagatataattcatcactcaaaactgattgttttacttgtacagaagccagtatgactgaagctctcttttcagtcaattaatgtccacttgcctgccagtttttaccatacatacctgtgccctccatgaagctaattccccaactgtttaggaaattcaaatggaactcctaaatagttcacacacagcttttgttaataaattacccaacatatttcaaccaggtcaggcttcacagctatacattttttaaaaagtgtaaattaactcttgacaagggaaattcaaaaccattcaaaggcaaagcctgtgaatgagacaaaggatgaaaggaaaatagatgaagtaatgcaatagccagctgaggaggaaaggatgccaagtagctgtgacacaacagcatgaagcaaagtgacttcattaatactctgcaaagtaccagaatgctgcacaagacaacacttcgtttccaaaccaaacacaaccagagtttaccactattgattttaagtagcagctgcctaattgctagaaagcagatacttgagcagttgttgagatatgcaaatgcaaataagcattgtcacaaatatatctgtatcacagcgagtatggcttttggtttagttagttacacaatgactgtgatatttagccatcagagtaattgaactttataaagtaatcagcagtagcaaacaggtatataaatagcagttacttagatgatagtcaaatcacaattaaaaaatatataaagaactttattactgtgcttttatttcctaattttaaaaacattttaatctattccaacaataatttactttaaaatgataatctttgtcacaagaatgtttattctatgaatatttactcagcatcttccatgttaagtgtttatgatgcaaaaaacaaaaattttcctacagttatttctgtgttgctgacgttaaaagaattcatagaataaacagcttagggaaaaatgataaatgtgtaatcacacaactccttagcatcgttaaatatgtatctgaagagaccatattatattattcaactccctcaaatttaacaatctaaaatagtgatatattttggctggtgaaaattttagacttgacattctactgtggattatcaatttcaaagaattacattgccaagaatatgctacaaataatgttcatgttatactgaacctaatctagttttgcctccacaagttcagaagatacttccaatcctttgtcagcaaaagcatccattttaattgagcattctgttccatttactgtatatttaagttgttgttattacatagcaggaactgtactaggagaaggagacagaaaggtggtgacatacttttcctttcatggggaaacagtctaatggagagaaggacaagtaagaaaccacaaagtgtattttggtaagtgttttgagaggagctcttgaggctcaaaggaggagttgttggttgggtcccctgagaaagcaggccttgaaataaggacttgaatagaattagtttatttgggaaatgattacagggaacagtagtagggagcgaggaagcaagacaggaaagagatagagtcaattaaaggtgcgttgtccagcaagttcccacctggctggctgaagcctaatccaactggggaagtttgggaaatggtgtaagacacagtctcaaatttatcacacctaagggagagggatttggagtatttataactgccagcagtccttggttgcagtctattcagaaaggtattaattctcttacgcttatgatttgcaaaggaaaagaaagtcctcagaccaaaacaataacagcaacaaccaaaaactgttttcgtttggaaggaggaccagaaggaaggaataagggtcaggcactgactctacaggtactcactgatctctttgttatgactatggagttttctttactttattcccacattttttcactgcactgggacctgcattttttttttctgttttgtcatttgtcacgtttgactttctacttttccttagttagatcgtgagaccaatcacagaaattatttatttatacattttcaaaatgtcttttcctctcctacccttcttcatgctatttcaaaaattacaccactggatacatttaaatgttcttcctgttttgcatctaaacccagcagtgaactatcactagagaaaaacacctgacttcagtgaacacctggtctcagataaattcatgaccacagacctcaagtaggtgctgagcacagccccgccatcctcttgctacccccatcctccactcccaaacttgactatttcataatggctccatggtcaaagtttgataaccatgcctcagctgatagtcttgcctcctatttcactgaggaaatggatgctgtcataaaacaaaatacttcattttatcactaacaattctacctaattatcattatctatgcccatgaactccattttccacctgttacaactgatgaactttattgctacggccaaaacttccaatgatacactggatctcatccctttttttgtcaactcaagaactttattcctacagttatccatctttcctaaaacatatatctctatatttgtaggattagtttcatcagcatttgaacatactctaggaagtaccacagtaatgtgagctttagtaattaaataccaaactaaatagcatttctaagcctcagttacttcatctatcataaagaataataaaatctacctttttggattattgttagcattaaataaaatgaagcataaaaagctcccaaaatatatgacattggttaatactttattattaatattctattacatagctaaatataacaaagctaaaatattgtcttctctcaagcatatcttgatttgtacattcattctggaacagatactcagactcaaagctcactggagagcagaatgagtattccaaaaatggccatcatatgtctggacccatattctcttctagaacattgcccctactccatcaagaagttgagtgtatgtacttctctctgaacctgggtaggtccttatgactttttgactttttcaactgatatggtatggcagaagcaaagctgtgtacatctaaggctaggcattaaaaggggatagtgcatccacctggtgctagtgctctctcgctctctctcttttctccctctctctgtctctttctctccttctcttaaaatgatcacccctggaaatgagccaagtaacccaggctacttggaccagcccatgttgaaagaacagaagttcccactctgtagtcatggctatgctttacagctgacagagcaccaccttgcctgctgtgtgagtgaaccatcttagaagcagatcctccagtgttcagatgactcacatcatctggtgttgtatagatatggcttttacataatgacacaaactcaatatttttaaaacatttattcatggagtaacactgccaacttggactgtgagagcagagacactaaaaaatgaaaaggggtctttagactccaaatttatacaagcaggaagcagactgagaaaactacttcatcaaacacatgttacatattatggaagaggaaggataattcagaagcagaaccaagaatttaaagaccagacccaagagccatggagctgacatgacaaagtgccacagactgggtgacttaaacaacagaacttgattttctcacagttttggaggctagaagtctgaagtcgaagtgtcagaagggttcgtttttcctatggcttgacttcttggcttatagattgctgtcttctccttacatcttcccagtggtctttcctgtgtgtgtgtctgtgcttaatttcttcttcttaaaagaatgccagtcatattggacaagagctacccatacaacctcattttaattaactctttaaacatcctactcctgatgaagagtaaactgaggctcaataaaaccttaaagagtttatttgagcaagcaacaattcatgagttcggtagctccaaaccagaagtggttcaagagctccaatgaggaaatgcaaggaggaggcttttataggatgaatacagagggaaagcaaagaaaatatttgattgagtacaattatacaattgccttctttggcctatcccattggaaagtctctagttttacaattataagtttatcggctacttctgattggttgagcttaagctctgcttttctttaatacaggcatttacaagaagtagctcaagttaagtttcactgatgtttgcaaatcaagcaaggtttaagtcatttatgaggcctcactggtttcatcttctcagagattttttaggccttgtctccattttaaggtattttaacactccaaatacagtcatattctaaggtacttgggattgggatttcagcatataaatttgtggggacacaatccaacccataacaccactgctttgggatttcttcttacatggtaatagataatccaaacatcccctgtttcctgataatatcctaaattgtttacacagcacttctggaagtgtcctttctcattcacttttgaaccatttaaggactaggactttactttgtgtttctgtagtcttcatgcatagcacaaatttcacaatcaaagcagccctggcacataataggtcttcaataaatgtttcatgattaaattcctcaaaggccgcatcatgctctctaaatgttttttcaatgtgcatctcttagaatggtctactgtcatctattctgtgatggaagaggcagtgtcactttttttggctaataattgtcaactcagcattcaaagccctgcaatttgactccagtctatctttcttgcctcattttccacttccccttaccacttgcactacacttcaacccgtcttggccataagctctttcttcatcatgttccacattttttccattgttggctatgaataagtgggcaaatgtgcagaggtctacttccttttggatatttttcttgattcctcctaaccatctaagataattgttgtttctggtaaacgcttttacaccattttgtactttggcactcaccttattctatcatgtaattcattcatatgtaaactccttctaccttagttctcagattgtaagctgctgtaaggagtgcttcatgttcatatttacactccctgaagtcctcagaagaacatctgtagcttagtagatcctcaagtatatgttaaactgccttaaattgattaaaaactaacttaagtcatctccccttatggatattaagtatattgactttaaagggttttcttgctgctacaagtcataacagtaaatagatgtagagagaaatgtttacaaggactataattaagcaaaataggctttctctgacttttgcaagcaaactaatttgtgtgtatatcatttagaattgattaaaattttaaatttaatatctgaaattatttgattattttggttcttgtgttatagttatttcttctgatatctgatctgctatgatgatgtaggataatctcttccaacttgatttacaaaacttgttttcaattgctgtaccactcacttcctcaaaggttgcctctcatatctcctcatcatatatacctcttcaaattcaatcgagatttcaattcttctcacttctccccaacctgtgagtaccactttgttgcactgtaaaaatgcataagaactccttcacattatttgaattttgcaatatattatgtattctcagaaaaagcactacattgacacccatagtgttgaactacataattttaaaaagagctgatttgagtacaaaataattatttaactgactacttaatatctaagtatatctttcacttaaaacaactgatagaatttctttgaccaacaccagcatctcatgtgacttagtaaaaacatttgtatatttagatactggcaacagaaaaatggcttggagatttctcagcaaaactattctgtttcagaaatgttttgtttcatattttattagtatataattataatactctaaatgtcagttacaaaaattaaatgaatagttgtgtttttgaatatttaccacctcttggtgttctgctcaataatgtacagtgtgactaagtatagtaactctatgagtgactatacagaatttcatacccttctcctcaaagagtggttaaaatacttggagaacatctccattctttaatagatgttagaaaaaatcactttaaaaagtcctttagatttaataatttaaaaaacgggaactcctttttagcaaaaatttgattataagggttttttaagtttccactattattgaatgtcagttaattcttaattcattcttctgtatcttctgaaaaatgtggcagtgaaaaaaatttcaatcaaccacaattacatgtctaccaacccaataatcattaagttaattaacctttaaattcaagaatcaactaaaaggaaatgttcattgaaatcagtttttaaacaaaattaaaagtaagattccaagccaatattttttggttaaagtttttagctttcaaattcagatgataaagcaaactaaatgaataaactatgtctttcagtagctataaccctagttcatatagtaggaaattattgtcatgctacatgatcaagtcaactaaagtgcctaggaacataggagttatttagtcagtccgatctagaccgttttgttaagttccagaaagtatagaatttacttaattggcaccctgataaatggttctccaatctaattggtataattaccaaaaggcaggtacagtgtaatgtatttaaatgactcaaatcaataggttcatggaatatctttttcatttaaagagagttattaacttattcaatgtagtctactacatatcaatatctagctccaaatatattctagtataccttgtctccagatctatgattaagaaagagattataagtgctttctatggttttcatctatctggaacaaaattgaaaacttagcaaagggagattcttttcaactaaaatttatcagagctgcgctgaatatactttcttgtttaccaagaactgtgtgatgatacttaaataaatgattatttccatcacctatcaaaatgttcgaagccttgattttcatctgtcctattatagtccatctattgtcttctctgatgcacagtatcatgaagaaaaagttaagaattattatgaaggaagtgtcttcttcccttcagcaggaaagatgaatgttttactcatgaaagttatgaggtagaaaaatagctattccattttgtttttcacttttgatatgatataaatttcagtggagaccttagagattcataagaaagaaaatgaaaaacaaagtcctcaaaaatacttttttttttgtcagaagagcatcattatttttaagtttctcacaaacttgtttgttctgtctccagtactttgatctcctggtaattttagagtaattgagaatattttctaacatacgtgtcaacataatgaaggagctgggacctaaatgaagaagcgacagaatttacagtggctttgaatgctggttcctgaatggatttgcttgactgcaattcaatcttttttgtggctcaaggctcactcacctctaaaaggtactttgtcagaatcgatttaaatcaatttctgtggaaattaaaattaaatatggtatccctaagattcttgcatttatttcaatttttaaattattgatttatacatgatttttatgcccctatcattatatgaacatttatataattagtgctgataaccaatatgcaatttcatttctttctctgagatagctttcattacatttacttttcacttcagaatctggcattccagtcttcttgaagcttaattcttttattgaaatttagttatagatatcccatgatattctctccctggaagttggtattataagcttgttattgtttgtttaaagttggctatagaaggatattcttccccagtttgtctttagaggttagagcttatcaatttttttttttaagaaatttggggaggttgtttcacttgtgatcgtcaaaagttctgagtttcttttgttgttgttgttgtttttgtttttgtttgtttgtttgtttttgagacagtctcgttctgtcgaccaggctggagtgcagtggcacgatctcggctcactgtaacctccacctcccgggctcaagcaattctcctgcctcagcctcctgagtagctgggattccaggtgtgtgcaagttctgagttctttaaagctttttaaaaaggattttctaaatgtttttctcttaggagatttagaaattttatctatatttcattgcattgcaattacatctgtgtcctgaaacattggttattcttccgggttttgatggttactagatgagtgtgtgtgtgtgtgtgtgtgtgtgtgtgtgtgtgtgtgtgtgtgttatgaacaatgctagattattggggaaaatcagaataatttgaatgccatcacactatccacaggaaaggcatatttgtttatacaaaattgtcacaaagagaaacgagaaaatcttttgtgatcatgcaggaccagaaagtgataaaaatatatggttctgtagaaataaatgtttagctggaaagaaattggcagttttcttctttgtatttgctaccaaatttcttcaaccttaaagttttacaaaattgttgatacacaggaagaaatgagaaaagagaatataggagaatttattttagccagtgagaaattttagaatttggtggatataatgtataatataactataaattcaaaactgtacttgtctgtgatatcattagtagaatcttttagaaatcaggattttaaaaatattaatatttgtaaaattaacattgacacttaatacaaaacatacattaccttgttatgttgctgcatatccagagtgtaaactaatgatgaaaatcataataatgatcacaatcatgctaacagaaaataacatttgttgggttcttactctttaacatattacctaccgtttctcattgagttttgtggagatagtatgctcaatgattttactagataagaaaacattacatcacatatctcatacaatttcttactgttaaaattaagtatgatgactaaagtaattataaaattctgttctcaaatgcacattattcacacacacaatatttcttttgtttgtttgtttgtttttgtttttgtttttgttttgcgacagagtcttgctctgtctcccaggctggagtgcagtggcctgatctcagctcacaacaacctctgcctcccgggttcaagcaattctcctgcctcagcctcccgagtagctgggactacaggcgtctgccaccatgcctggctaatttttgtatttttagtagagacggggtttcaccatattggccaggctggtctcgaactcctgaccttctgatccgcccgccttggcctcccaaagtgctgggattacaggcgtgagccaccacgcccagcccacacaatatttcttaaaatgttatggatttatattttatctttttaaatccaccattaaggtaaatgtattcaccagacccttagggtttcagcaaagaacgtgaacttttctcaattcatttgtttattcactggtaatatttcatattgaaattgagaagacgagagaattatgataaaagtcgcttttgtccagtcaatgctattaagcgagttaaccatagacattctctcaaatcagctaatagaattgtattttcagtggatatttttaattgcattaaatacaaaagatataaactaaattattcatcctaattatacaaaaaagatgataaacttaagcaatatgactatctgtataattcactcagaaattaagattttcaaatcaccaacagtttagatcaaaacaaaaggtataaataaaaggcctctaacggtatcaactacctcctaaatttcaataacagaatcttttatgaaatttaaattaatacggcattattgaatatacacgaagcagaataatccttaaatatatttgtgccgatctggttttggagaaagttttaaactttatgaagtcctaatatataaattgtttttatattatggaatacttacaaatatctaatgagctatcttggcgacgagacctaagtctaaacataaaatttatttatgtttcatgtatgtcttatgtacatcacctgaaggtaattttatacaatattttaaataaatttgttcatgaaacaaagttttgatggcattttattatgacctgtcaccgaagatcaagtaagaaattttccgatggcatgtaggtgctcaattttagattttagagtattctggattgggggcattcctaatccaaaaatctgaaatccaaagtgctacaaaatttgaaactatacacaccaatacacaatacacacacatatatatatttagtttcctgacatgtgtgcctgtatatgtgtgtgttgcttttacagaccatgtctttgtgttggacatgtcagtttaatatgcctgccatatcccaattccatttaacataatttgtcttcttcgaactcttaaaagagatatgcaacataccagctgacctcacatgaatggttatagatacaggcatgcctcattttattattattttatttattgcactttgcagatatcacttttttttttttaacaaattgaaggtctgtggcaatcctgcatccagcaagttattggcattgttttccaacagcatgtgctcacttcttgtgtttgtgtctcattttggtaattatcacaatatttcaaacttttaaattattacgttatggtagtctttgatggtggtctgtgatcattgatctttgatattactattgtaattgttttggagtgcctgccatgagccacacccatgtggatttaataaatgttgtgtgcattccaactactttgccaactgctctctcatctctctcactctccttgggcttctctatttcctgagaaaaattgaaattaggccaattaataaccctataatagcctctaagtcatgggtgttcaatcttttggcttccttaggtcacattggaagaagaattgtcttgggccacacataaaatatactatcactaatgatagctgttaagctaaaaaacaaaatcagaaaaaaactcataatgttttaagaaagtttacgaaatttgtgttggtcaacgcatatcctgggctgcaggctgagcgttgaacaagcttgttgcaagtgtccaagtgaaaggaagagttgcatatctccctctcactttaaattgaaatctcaaaatgattaagcttagtgaggaagggatattgaaagctgagaaaggcagaatgctagtccttttgcatcaagcagttaaccaagttgtgaatgcaaaggaaaagttcttgaagtaaattaaaagtgctaccccagtgaacacaccaatgataataaaatgaaacaactgtattactgatatagaaaacattttagtggtctggataaaagatcgaaacagccacaatagtctcttaagccaaactcaaatccagagcaagaccctaactgtcttcaattctgtgaaggctgacagaggtgaggaagctgcagaagaaaagttggaagctagaggaggttggctcatgaggtttaagaagctatctctataacataaaagtctaagatgaagcagcaagtgctgatgcaaaagctgcagcaaatgatccagaagatctagctaagatcatcgaagaaagtgcctacagtgaagaacagattttcagtgcagaaaaacagccttctgttggaagaagatagcatctaacactttcatagctagaaagcagaagtcaatgtctggcttttaaagcctcaaaggacaatctgagtcccttgttaggggctaatgcagctggcaacttgatgttgaagccaatggtcatttatcattccaaaacttctaggacccttaagagttatgctaaatctactctgcttgtgctgtataaaatggaataacaaagccttgatggcaacacttctatttacagcatggtatgctgaatattttatgccctatattgagacctacccttcagacaaaaatattctcttaaaaaatattactgctctttaacaatgaacctaatcacccaagagctctgatggacacatacaaggaaatcaatgttgcattcatgcctgctaacaaaacatccattctacagcacatagatcaaggagtaatgtttgctttgtagtcttattatttaagaaatattttaaggctatagggctatagctgctatagatagtgattactttgatggatctgggcaaagtaaattgaaaatcttctggaaataattcaccattctagatgccattagtgatttctgggaagaagtcaaaatatcaacatttgtagaagtttggaagaagtcgattccagccctcatggataattttgagggattcaagacttcagtggaagtccctgaagatgtggtggaaatagcaagatgaattagaatcagatgtaaagaattagaattaaaattagaattagatatcatgcctgaagatgtgactgaatcactgcagtcttctgataaaacgaacagatgaggaattccttcttatggctgaacaaagaaagtgattgatttcttgagatggattctactcctagtgaagatactgtgaacatgttttgaaataaaaacaaattatttaaaatatttcaaaaacttagtagataaagcagtggcagagtttgagaggatttactccagttttgaaagaagatctaccatgggtaagatgctataaaaggaaatagcatgctacagagaaatctttcatgaaagaaagagtcaatagatgtgacaaacttcatttgttgtcttatttcaagaacttggcatagccatcccaatcttcagcaaccaccattctgattagtcaacggccatcaacatggaggcaagaccctccacaagcaaaaaaattacatctaattgaaggcttaaatgattgttagcactttttaacaataaagtatttttaattaaggtttgtacattgtcttttagacataatgctagtgcacacttaatggattacagtaagtgtaaacataaattttttatcaactgggaaaccaaaaaatcatctgacttacctttctgcaatatttgcattatttgggggtccggaattaagcctgcagtatttcagatgaatgcctataattagactggagtgtatatttgattctaggagatccaatcaatagtcaatcagttttttctttatcagaaataagaggcagagaaactgtattctgaaggcaacaggttctgcgttggacaagttatgtaaaagttttggcctgagctgacaacattgcaaattattacaacctcctaaatgatgaataaacagaaagggtgggcagggaaaattcagttgtagactaaaagagtggaacagactctaagaagcaagaaacctgcaggatcagaaagatgtgaagctaaagtacttgttttaagatgccttggatcctatgagtccacatttccttttcaaatcttttaaaattttcaaaagaagacatttatgcagccaaaaaacacatgaaaaaatgcccaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaattaccatttgacccagccatcccattactgggtatgtacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacaccgcttattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcaccagcatggcacatgtatacatatgtaactaacatgcacattgtgcacatgtaccctaaaacttaaagtataataataataaataaaataaaataaaataaaaattcacccagcctgtttttcttggaatattttgagtgggcatttattctttacaactaaaatgattttcttttttggcttttctttcattagataagtgtatacatcttggaaaaaaattagcatatcaggacaaagttacatttatacaattatatttcattatttttcactaaaaacatatgttactataaagcaggtagcagagtttatcttggaaaagaaaggcaatacaatgatggtctttaaatgtggatggagaggctccaaggcatgccaatgtgtcctacggcatgacacagctgctggaggaggcagaggtgagggtaagaaacaatgtaaaatattataagggaggtgactcaaaccacatggagtatgtgcacatgtgtgtaaacatggatagaacttatgtttctaacaaagtgattcattttctgaagtcagggactgttttattctcttgtacttctcaatgtcttgaatagcaataagtccatagaaggagccaaataaataagtgaatctgagttttgccttcctcaatgaccttgggcaaactgtttaatcttgattacaacacaaatattttttatagctataataaactatagctgtgttgtgattggaatagatgaatgaatgaatgaatgttttttcagaacctgttagtaccagcatattagcaaggttagcaaacaatcctaagccctccaaatctagggctttctcactcccctatccccgcaaaaagatggatttcttactcacctcacatgatagctgcaaataactgctggtctgctccatgtattttctccatcatggaatccagcctgaaggtgaagctcctgtctcccacattgctgatctggtggcagagggaaaggagcaattgaataacaacgtgattatgctttaagttgctgctcagcaatgtcataagttatttctactaacacgtacattgaccaaagtcagtcacctgactcaatgggatgaacttacaaaccactcacagaaactaatactgcaaataacatggcaatgagaagtaggatatggaaagacccaagacatttctggattaggtattgttccctgaaagcaaaacatcttcagttctttatttgtcatggatcttggaactgacgtctacaaagaccttctttttccattctcttcctcggccatatctgaagaggttattaaaggatatgcccttcttggtggctcagatggctttgcagcctattttctgcctgtaaaagtttggatctccatatggggttataagataaaatatagtgttcactgttaaatttgaattttgataaactacaaataatattttagcataagtatgtcctaaatattgcatgagatataattatactaaaaatattatttgttatttatttgaaattcaaagttaattaggcattctgtatttttatttattactctggacaccttagtactcaaagggaatttcaagtctcaaataattatagtctgtttaatttagagtgctggcacaactctctcaaaagcatagtaagatttttatttatttgataccagtttccagtgccaatgtacacactttttccccctaaaataggcctttctctctagttttagctgccagtcatttaaacttagcaagattctatgggaaggtcttactctgagtctccttttgagtaattttgaccaattggaaagattgaatgggtgccacattagttatttctgagttttaataataggctttagcttccttaacacccaatttggtctttgtcttgaggctgagtgttaacgagcctttgtcactaaaatttcacaatgttacgttttactgacagaaatgtaaaggaattacacctcttgtctctgttagtaaactggccaattctttcttttctcatcttgttcttcaagtaccttatcaaatgctgccaacattacatgagtagctttctgttttccaacgtctccacgtacagctcaagctcatacaatacattgcctgtcttctaagtaattacaagcaacaatgatattaaatgttccgcttatacatatgcataatgagttgtcttgcatcccatcaacaataaataccctcttagacaactaccccgttcaaaagccaatggcacatatactggtgttctgtttcagcagaacacagcttacatgttccattttattaattagttaattttgctaggttacactgtactctgacaaaatcttagtggcttactacaactaagggttgtcttactccagatctcagcagaaaggctttcaatttttccctgttcagtatgatgctaactgtgtgtttgtcatctatggccgttgttattttaaggtatgccccttctatacccagtttattgaagggttttaatataaagggaggttgaattttcttgaatgctttttcagcatgtattgaaatgatcatatggattttgttcttggttctgttaacgtgatgtatcatcttcattgatttgtgtatgttggactcattgcacccttgtgataaagcccatttgatcatggtgaaaatctgttgttgcattcagtttgctagtattttgtggaagatttttgcatttatatttttcagtgatattggcttatagtttttgtccttgttgtgtccttgtctagttttgataagtgagtaatgttggcttcatataacaagtttgaaagtatttcctgctgttcgattttgattttgaagaatttgaataaattattattagcttttctttaaatgcttggtagaattcagccatgaaaccatcgggtcttgagcttttctttggtgggagacttgttttatggcttcagtcctttacttgctattggtttatttaggttttctagttcttcatggttcaatcttggtagttgcatgtatccaggaaattaaccatttcttctaggctttccaatttgttgacttatagttgttcataatagtctctagcgattctttgtgctttcagctgttatgtctcctttttcatttctgattttattgggtcttttcactttttttcttagtctagctagagattcgttgattttgtttgtcttttcacaaaaaacaattattaggtgttagtaaagcaacttacttgtatggagaaattttatgtcggagaataacaagagctattatatgtgaaggtaaataataaaaattatttaaagatttcttgtaaatttagacttttttctgcagaatacgtggaggcaagtagtgtcttcatgaaaccaggctcttaagatactgaaatagtatcaacgtgttgagtattaaaaagtgacacaattgagtggtactatgccacttcagtgtactgaggaagtaaatgttaactttgcaattgctatatactgtaaaaaaagaaagaaagaaagaaagaagacaactagaagattattatatagttggcacgtgtcttaagtcctacctgagattagaaagtttcattgaatttttctggctaaaaaaattaaattaaatcaattataaaagtattctacttacacttgtcattttagcatcaatggaattagaaaaaaaaagtacagtgactgaaaaaaatcttgcaaaataaagctaatatttaaaaaaattttgattccttgaaacctcctcaaattacgactttgtgccacctcattgcgagtcattaatcaatgcacacttaaccaagaaaataaactaaaaattaattttgtgcattgaaaaaaatccaaatcgacttgtcagtaagagaactaaactcaattctaaatcgcatgtgtgaaaacaaagagaggcatgaaattttagggtctgtcacattagctgaagatgtcttaacatgaatgtgccactgttgttaaatgagagcaggaaaaggaactaggagttttcaaatatcaatgtccattgcttttcagaaacagcatgtacagactgggtttacttgtgctatgtccatcaagatactcaagttactagaatcttacattttggagtctcacttatagaaggaccttgccctgaaagaaaggtgaggggaaataacttcagattaaggtgcaggagacctgagctataattcctgctctgccacttatcatgtctaggtcttctggtaagacttaatttacctctgtctcagtgttctctgacaggagggagttcgacttagttcaaaaatcacaaaacaacgatggagatttcaccactttcttctttttacattggattaaataaactattatctaaagatttggggtcttcatatttcacacagaaatatatattgagtagcaaaatcttaaaagagtattaaacatcttctaaaacatgacactgtgaaatatcccagagaaactttaattatatgattatctaaatacttgatggtctagagtctctattaaattgattaaatttaatgattaaattttaaataccctcaaatattagccacacaacaaaaagagcacttgagtagttgtttcctacattcagctctgaaatatgccaaatctgtgtttataaacacagcatcacagaaatggacctgcagttgaggatatgaactggaaagaccaaaatttaacaggtaatcctagcctaatttgttgagtgctcactatgttctaggcactattcacatttcacattaattaacttatttaattttctacaaactttcacatagggtatatttgtgattctcattaagtctgacaggcactgttgatctgagttaagtctctaattctgggcatccaaggcctctgtcctctctttcttcatctcttattgttttcaagatgagatgaattaaaattcttatttgttatgcatttggcataccaccactcttcctgctcatctgtgcttataagattttaccctgcttgcataagtgttcatgagccctcaattttgaacagctgtgaggaaggctggttaactatttgtaaacaccacccaatgatgcttgacagtgatggcagtcttgcagaatactgaagtgctattttactgggagtgataatgagactgtcttgtccagaggtctggttattacaccaatactaaacattatcatttagttgtctggtgtaaaataatgaattagtcccatatattttatgaggctatatccacatttttttcataacagaaaaaaatggtatatacagctatgagttttattgatataattcaaatttacaccattactgagttttctaattatctgccttggttagctttcagaacaaatacagaatttatattgtgaattactccttcttttactaaaaaaaaagtctttttatcgagttgttggcatgacgtgattactaactagtagttatatatatatatttatatatatataaaactactcatatatatgcatatatatatacatatgagattatttgaagtagaaagtaggttttctaggaaaaaataaaaaataaaaccaaagaaaaatagagttaataacctttacaagagtaatatgatatttaattatataaatgacatactattcatatgttttatgtcatacagtattaatgtatattatacataataatacatttttctaaagacccaaatatttttcctatatggtccataagcttagaaataacaattgcttttattatatcaaattacaagctagctctaagaagtcactcttactaattagggttgaataacgaagacaattacaattgaaaaagggcatggcttctaatgagagatcagtaaatagttgttgaataaatgtataaaaagttatgaaagcttccactttttttctaagagcatgtagcttgttaagttgcaaagatgcaaatgaaagctgtgtttctcattgcaattcaagacctgtgctgctcccatttttatgcatgtagctttatatacctaaatctttttttatgttactaatatcattttgtagatttctatgtaaagtttgtgcacacttttcataaagtatgcacattactaaagtatttataaagttgttgctgatatgaatgagacttatttttcaattttattctccaactggttatggtaggaatgaaaataatatcatttatattaaattctcttatttattctaaagtgttttgagtacctactatgtgcaaggaactatgctaggaattgggataagtgggaaaaatacaaagaatctgtcttcaaggagcttttggcctacatgggccaataaccctgtcttgagtgagggcagaatggaagaattgtaattgagactgttgagacaattatcctgtggcattcttgcacctctctatatctcgatagcagaggtactgactgcctttgtcccaactatcttttcaatgatatttgtacagtgaatagacttggaagatatagtatctcagtccagagcgaagacaggcttgcttatagtcttagaagtataacctctctcttggcagcaaaaggtagacatgcttattattcattataaaagttgggctccctaagctcaaggtttctctcctgaaatgcaacaggtatgcaggtgtcactttaaccctcttggcatcaccctatgggaacagagggtcagagaatcagagaaaatactaaaactctgctactgctattgccatgattaataaatttttttccctgacccaggaatgtcccatcttctgccagcatctataaaactattgaagcctaacttgttagcttgcaagtagagtaaactatcaaactttttaaagtttttgacatggatctaaagtcaaagtaggacataaccaagccaaagcaggccaggggtaaggacttcataaagagcattgtaaaaaaaggccatcacatttattggcctggtttgttcagcatcacagaaatggaactgcagttgaggatatgaactggaaagaccaaaatttaacaggtaatcctagcctaatttgttgagtgctcactatgttctaggcactattcacatttcacattaattaacttatttaattttctacaaactttcacataggatatatttgtgattctcattttatacccgaagaaacaaaggcaaagaaaagataagttacttgtccacagtcacatatttagttagaagtagaatcagaattcaaactcaagatgcatgactctagagtccctggctcttgaccttagactttatatctcaagatggacttgaatcgaggccatatcataaaagtcttgtaaagcacacttaggacgatagacttcatgctaggaaaatgtgtgctataatttggatgtttgcccctccaaatctcatgttgcaatttgatccccagcgttggaggtggagacgtaaaggggagtgtttggatcatgggggtggatccctcatgaatggcttggtgagttcttgctctattagttccgacaagagctgattatgaaaaagagcctggcacatccccactgtctctctcttgcttcctctctctccatatgatttctgcacaggtctgcttccctttgccttccacaatcagtggaagcagcctgaagccttcactagaagcagatgctggtgccatgcttcttgttcagcctgcaaaacaatgagccaaataaatctcctttctttatgtattacccagcctcaggtcttcctttatagcaacacaaatgtacaaagacaataggtaaccaccaagaggcagggaaatgacctgacagtggtaaactttgtactctggaaaaggacaaatatcagaggcagtgtagaagctgctgcagtagtctaggttacagacaatgatcacaagaagttaaaaagacaatttgggatcccttttataagctttttttttttttttttaaatctgtagcaccaagaacaatgtatagtagcaatatgtactcagctgatacatttcaaatcaataaattaatctggtcaccatcttaaaacctctaattctaataatatgagtgtgcatttggtaaaatgtatacaaatgtgtaagcatatgtgcacaagtatgtttgtaaaaattttaagacgcaagtaatggcaaaactgaaagacatttcattcaattttctctgatgttgagctttgcagttggcataatgctaaacccccttaacttgaaatctcatgaaatgctgttttataagcagtgatgttggtccttggatataaccacatgtcctgctgcagcctggatcttgcatcaggcaattccacaacttgaactgggtaatttttgtcaaaccatggttagttaacttgggcctttttcttaaactggagcttgcattggcaatctagatttcctgtttttttgcagccataacatgcaacggtgaaagaagcaaaagtctggtcagaggaaaaaccaaaagtccggtcagactctttaagagtaataggactctaagttctgaccagattttggtttttcctcttatgaaatacaactaaataaaaagttttcttagattaagataagacatcaagtttctgatttacagcagatagaacctcagagaaaaggatgcttcacatgacactggactgcatttgcattacactgattattttgagagaactgaaataaaaatgatgtatttaatcaattaaaattttattttaattaattttaatttagttagataatttcatttaattgatacattcaattaatatataatttaattaatatttttacttaattaaaatgtaattattttaaaatatgtaacatatttctgtatcactagcctcttagagaaggccatattttacacatatgtgaaaagttctttgaaggagaaattcaatatcattatccatattatttatgtgttttgggaagggtcaggacaaggcactagggttgacatcattatccattgcggtggtcacttgactttccttatttaattttatttaaattaaaaatattggttggatgcagtggctcacacctgtgatcccaacactttgagatgccaaagggggcagatggctttgagctcaggagttcaagaccagcctgggcaacatggtgaaaccctgtctctaaaaaaaacacaaatattagtcagacatggtggctcatgcctgtggtcccagctactcaggagtctgaggtcagaggatcccttgaacctgggaagcagaggttgcagtgagccaagattgtgccactgcactccagcccgggtgacagagtaagactctgtcaaaaataaaataaaataaaataaataaaatggaataatctttgaattctaacctagactcttaccaggtggaaaaacttatctggaatgaaaataaaattaactgagaattacctctgtgttaggcattatcctcggcattgttgattatttcactatacctgaaaaatattacaagtcaggcatttttttcctcagtattattttaaggtggaatttagaaagaaatgacaactaataagtcaaaaaaactgaatgttggcaataagttcatatgactccattgaacaaaattgttcattctgtttgaagttatacattaatcaatttttaaattataatgccttttatatttttgcctttacaataagtaatattctagttttctttattatatttttgtcaaacaaaatcaaaaagtaaaattttaaaaatgagaatactttgtttgattctatgtaaataaatatgacaacctaaagaaaatatgcaactttttagagtaaattaattacaaaaatgaagaaaacattgaaaactaaacaaaaaaatcatatataaaattaataaacatggcagagtaacactcggatagtgaggtaatgaaggttttaagttaaatgtttaaaccttcagaacttaaaccaaccagttgtgctaattctatttacattattaaagagaactaagaaattcaatgcttgccaacatcttttataaaagcagtagaacattgataccaatacctgccaaaggcaggttgacaaaaaaatctttcaagctaatttttgtatgttaatacacaatccaaaataaaattatattttaatgaactattagaataatctacaaatatttgaaaataatataccctataaacagtttataagtggaatgcaaagatggttcaatattagaaatttaatgtaattagttatgtcaataagttaaagtgaaaaatatgtatttttcataatacggtattagttaagataaaagttaaactgcaagactttaaagtaacaccagactaggatgcaagatgaacaaattagttaaaatagtgtgcactgaaaacaaaaatattccatgtgttactgattttgaaaaatttcaaagtactagagaacagaaataaaaatacatcttgaataactatgacctttcgtctagaaaagattgataacataagaggcttttgtttttgttttgttttatccataaataatttgttatgacacattatcttgaggaattacagaaacattagcataaaagagtttaagtctacaaattaaaaaattaaattctacaagttattttccatgtatgtcttagaagaactgcacaaaggagtaccagatttatttaataagtaaatagaaataagccaatataaattctagaaagaatattatagctgacatatatatatatatatatatatatatatatatatatatatatatatatttttttttttttttttttttttttttttttttttgagacagactctcactctgtcacccaggctagagtgtggtggcatgatctctgctcactgcaacctccaccccttgggttcaaccgattctctggcctcagcctcccgagtagctgggattacaggtgcctgcaccacgcctggctaatttttgtatttttagtagggacagagtttcaccatcttggccaggctggtcttgaactcctgacctcatgatccaccagccttagcctcccaaagtgctaggattacaggcatgtaccactgtgcccggccaacatttatatatttttacctgacactctttctcttaaaaagagagacagagagagaaaggaagaaggaaagaaaatctcacttccaaccctgattcatatgaaaaatgactccatacttatagtatcccatttcttccccttccaaccctgattcatatgaagcatgactccatatttatactaccccatttttccccttggccaaaggttaaatgaaagatgggctcaagatccaagttatgactattaatgtttcctctttagtaaattgacagagtacagtggtattccagtcccagttaaagctggattcttgaagaggaaatggaagtgtaaaaactggagagcctcaacacacctttcatatttttcattttgtacactagaatgtagagaaagctggtctgtgaagagaaacactgatagagatgaaaagaaaacagccatataatgacatggagagtaagataggaaacgaaaatgaggttttccacagtagggtgagccctggctccagacaattgtgagctaaaatgcaatttctcacttggtttgtgaaatatcccagaatccttatatttaatattacattgtggtctcagaaatgggtgtaatatttttcaaagtttaaattatatattttatcatcactttaaattataatatttttgactttcattcattcaatcctagggtttccgtgattctggagaaattctgaaataatctgaacaaagttgccaagtgtttgtggtaaatcagggtttggtgtcccaataaaacaatagatttgaaatccagacttaaataaaagacaaaagaatttacaaattccaaattttcttacaagttaaaacattttggagatctgaattttatgttttattatgtagaatataggtggaaagaaagcaactacaggctattccagagaaaacacatatgtgagtctgtagactgaacagggtaggagagagagagagacaggggaaaataaaaaagtaggaggcaagataccagtgtctttagttctccatttcatctcaatctggttcactataggataagcctcaagatgaagattgagcagtgatggaaagccccaagagagggatggaggtgggggtggctaaaagaaaaggaggctggggccctacaacctattgggacttgaggaggccacttggctgaatatcccacaacaatagtaagcaaccgcagctgagtaatgatggctaaatgttcgtagatagtcctccaccctactctcacctttgattccacacattctaaacctaatgagggaactgtctcaaaagtcactgtgtgcccacaatggggaagagagaaaccactgggtaattaggaaggggtcagatgaatatcatgatggagcttcagcagaacagcagtggcaggggaagctgaagtggagccatgtcagaacagtgtaacctgtttgtacaaggaaaaggacctgcaggcactcactgtgcagaaaaaaaaaacaaaataaaacataaacatgactttcatctgtcatagatgtcagaagtagatgagcaacaaccaagtgggacaaaggacatcctaggggacaccactactcaaatttgagattttctgatgcctcatgctatgtccaggtaccatcttggctaggagaaagggaaaaacaaaccattttaaaatgaaagagatgagttacctttaaatgacaaatttaaaataccatctatcctggctcctcccaccaccattaaagagaatccaagtttcagaaaattagataaaaagaatatgacttttttcaggtataagttcagcatatgtgaaatttaaccacttaccctacagtagtaacacatgatttctcttaaggccaaagttctaagaaatgccagcactgagcagagaaagaggaggctgtttctgttgatcccaaccctatatcagaagggatattgtcgtggctatgataactagtagcaagacagcggccatccctacacttctgttatgtggcagcatgatcattattacataattaaattgtttatgttttacacatctgttttgttctatgacagattatcacaaatactctttggttatccttggttaaagaccattagtatttaatcaaataagtttagtgtagataattcttacttttaagcaatttgttgaattaaatcattatgaagatcagaattccaatttggacatttgttttctaccttcagttatgattttatagtgtagttgtggggagtgtcttcaagggaaagaaataacataagttcagtaaattcaggtcaatggtttatattgaactcaactggtagtaatgaaaaaaaatatccttccaactcatggccttcctatgagcacatgtgaaataagttgcttgcctagtgaaaatctcaaggtgactgaaaacatgcacatcacaatatactccagtgtgcatgttctaggacatgtgttaggtagtcttggtgaataagcaaggtaacacagtattcttaagcactcctccaccattcaagaaaagatgagtgcagagctagggggcagtcatgggtcagtgtcaatgaaaagtgaagaaagtgaggacctgaactttctattctgcaggtcagttaggtcttgctgagtcagttaagacccggctagtcatcaacatctcagagcaaggtctgctcagcaggactttgcagactctgcaagtccttaagaaatgggttctgaaatgtccaataatagccactgtaattaaagcaactcctactcttaagatgcttggggtattttgataaattgagaagtctctaaatcaattatctgtgcaagatctctgaatgttcaaatagcaatttagattgttttaaaaatctgctttgagtgtctgtgctgggccaaatctgatgttgatcccataaattgccttcttccccttcaaaaaaatcacacctaaaaagaaagcgctggaacagtctctttcgaaagtgatttcattatatcttggctattaatgatggttacagtgtgtgagatattaaatcatgaccctgtaagattctggaacttttcctcagccagaatgtcattttattttaattctttaaggttgcacatttttttatcctaatgtaggatttggtggactgtaattaaacgatggtcgatggacctaaattttatgagcaattagatatactgtatttgctttttttacccctctactgagaatatatgctggctttgtggaatcactaagatgtatccctctgcccccacttgctttttagttcctgctcagtgcaaagaacacacagaattctgcaatgattttgttctattattgcttgaaatatctacttcacattccactggagaaatttaatgaatacaggaatgtaaagtaccatttaagcattttttctatgttctcttcaccttttatgtttctttcactgtataaactccgtcctcttcctgaaattccactccttttaactgacacacaaagctgaaaatgggcaggtttcaaaagcctagaacatcttatactcatgcaagaatataagagacttattgtgacataactttttttttttgagaaggagtctctgtcgcccaggctggagtgcagtggcgcgacctctgctcactgcaagctccgcctcccgggttcacgccattctcctgcctcagcctcccgagtagctgggactacaggcgcccgccaccacgcccagcttatgttttgtattttttagtagacacggggtttcaccgtgttagccaggctggtctcgatctcctgaactcgtgatccgcccgcctcggcctcccaaagtgctgggattacaggcgtgagccaccgcacccggcctattatgacataactctttagatacattcaatattttttaaaattagaaaacaaacccaaatcagaattcaggattcaaaataacaaggaaatttgcattgacagatataagctactgtcacaacagggccaagtatcttttctccaaattatttatttttagtcattttctttaaaacatttactcatatgattgttgtattatggtacctatgtcctcttgggaataggcattgatgagacttattaaatattatttcatcaataattatgtggcttccatacctgatgatggacacagctggaagatcattttcatcattatacttcttttcaaattattttttataatttaaaaaattataaataaacattgctgctgtgctgtgatcccaaagggcattatgaaaaatagatacacacacaaatataagcacatatccaattttacatattatatattattactaagggaagggaatatatattatatattgctaagggacgggaatacatattatatattgctaagcctctgaggctcctaccactcttgattcccatagcaacatagttgttggatcagtcaaaaccccacagagacatgcaaaagttcacatcttttatgctggacctcctcaggatactctaatttgctacagctgtgcccatgcccattcactcctaggttcttggcaagcccagccttgatggttgacaggtgtgggagctactggctcaggggaaagaaaattaaccctatttctgccagaacccaccctacaatagttaacacatagtttcttttataatcaaatttctaacaataccgccctcaacagagaaacaagaggctgattcattattcttacactcgaataaggagaatcttcatttctcaccatgatcaaccagtataaattttttaatcagtcagaaagctttctagtcctaaaagcactgggacccatgattatcactaaggatattacttagaggtggaaagatgaagatatgaacagctggtttagtagtcacagcagaagaccttgaaatatccctagaagagaagattttaggttgtttggcttatttggagaagaagagaaagccactgctctgttcctcctttgcatttttccctcttcagaaaagcaggctcttataaattttttaaaataattgagccattttgaaatggtatatttttgaccattttaattatttgatttgttttcgtttctgccttgtgcacagtcagaggtaaactaaaatggcttgtgctggtagtgggccatcgtaaaaagctcagatgacagtgggaaattgcttttgtgatgaagggaaacattaataaaagcttctctcatgtttacccttttaaattggccctagaggagttatttaaagtaccccattggcagtggttggctgataccttaggtgtgaaatgttctctgtccataggtggtagttgagtttggaaatatctacctttttctgacctcgtttggtttatcattgaagtttcatttaaactcttttgtcctcttgtgatatggtaaaggccttaagtctttgctcataaagaaaatattgttgtgtgtctaagaaaatgtcacattttgtgtcccacaagggtcttaagatactaaatcattctacctgtggcatcagggcttcaatagatgcaactggctagggattttattttattttttaatttacaagaaaggtaaccaaagcaaaatcaaagtaggtttttttgtttttaatgtgaatttcctacgctgccctatattcaactacacatatgagatacccaagaaagtgcactaaataacttttatagctcatttgggagtccttccgttgagtcagagagtaagaaaagattcatgtggttcagctgtccaagggtactgagcgtgagaaaccagcacaaagtgaaggctcccttaggatggcctctcttattcccactgctgtgccattccacaatgcttgtcttctcaccctcagcagtatgacaggtgctacactcagagcatctgcaaagacagttagtagaagatgagatcttttatagaaactcaaatgtcctctctggaggattcagttgataagggtacatagttggtattctatttaactttactttggttttgaatcttgaaattttctgcagtgaaaggggaggggaacttttatctattcagtagcctctgagggccaaggacttacattaatttttttgatcacttggtttttcacaacaaattcataaagtataggtgtttatctgcatctaattttgtagataaggaaattccaaccataaaaggttaaattttctctcaccaggcaaatgtgtgagaacccaaatgtttattctgatccaagaccatctctgttttctgtatcaagctttctcctctggagataaaaataggaaaaatgtaataattttttaagcaacatgtcatatgatgagtcttgaatattttctaattgaacttttcttcttggaacatagaaggaaatgacctatagagaaaaagggactagcaccaaatcacacagttctttttgtctcttttatgagtttaaataatatactcttctctaatcaagttttttgtataatttttataaaatttacttagaataacagttagatgagctttgacaacactagtgtaatcagcatcacaatcaagttcatagaacatttccatcacccagaaacttcccttgtatttatttgctgtcattctccaaccttttactttagacatcacgataagctttatgtcactatagattaatttttcttgatctagaatgtcatgtaaataaaatcatgtagtgcacagcttccttagcttgccataatgcttcttatatttgttcatgtggttggggtaacttagtggtcttttttttttaactgttagtaatatttcatcatacgcatatactacatcttgtttctccacccacttgctcgctcgttgatggacattagtatggtctacagggtttttttgcctattgaaaacaaagcttctgtaaacatttcagtgcaaggaatttcatgtctcttaggtaaataattagtagtagagttgatttggtgtattgtcaaaaaatggacaaactgatctccccagtggctattcaattttatattcctaccagcaacatatgagacttacagttgctccacaaccttgaaaacacttgctattttcaatagttttaattttagccattctagtaggtatagagcaatatctcattgtggttttacttttatttctgtaaggcctagaaagagtgaacctcttgttttgtgtttgttagtcatgaatgtatctttttcggtaaaatatttagtcaactattttgcccattaaaaaaaaatctggttgctagttttcttactgaattgtaagaatgatttttatattttgaatataagtcctttgtcagatatatgcaatgcaaatatgtccacctcatctttaggttgcctttttatcttcttgatggtagtcttcaaagaagagaagtgctgtattaattttgatgaaatcaagcttatcagttctttttatttacagttttttgcatctcatctaagtaacatttacctaataaaagatcgcaataattttgtcctatgttttcttctggaaattttaagctttctaaagtttttgagtttatttctgtgtatggcatgaggtatgggttatggttcattttttccacagggataggaattttttaaaaagattatttttccccattgaataaatgcaatatcttttttaaaaaatctatttactatgaaagtgtctatttctaaactcttaattctgttgcattgatctacctgaatccttacaacaatgctacactgttttgattactgtagctttttaaataagtattaaaataaggcaatacaacttccttctgaaaatggcttcagctattttaggtgtttgcattttcataaaaattttagaaacagtttgtcactgcttttcttttctttttttcccttttttttttttttttttttgagacagcatcttgctctgtcacccaggctggagtgctgtggtgcaatagcagctcacttcagcctcaacctcccaggctcaagcaatcctttgaccccagcctcctgagcagctgggatcacaggcccatgacaccattcccaactaatttttttttttcatagagaaggggtctccctatgttgccccaggctggtcaaattcctggggtcaagcaagtcacctgcctctgcttcccaaaacgttgggattgcaggcatgaaccactgcactcaacagcttgtcaattgttttaaaaagcatgactgaatttttactgggattgtatagcatctatatactaatttacatttcacttatatttaaagtatcttttaattgttccaacagtgttttcagttattcactgtgtacatcttgaatatattctgttaaatgtattcctaaatattccatgtttttgtatgccattataaatggtatattttacttgaaattgtattttctaattatgtcttgctagtttagaaatacacttgctttttatatattgctcttttatcctaagatcttgttaaactcatttattttaaacattttggttattgttgatgatgattctttataatgtcctatatacacaatcatgtcatctcttcacaaggacagttttattaatgccttctaatatatgtatcttttatttcatttttcttttcttcttgcacaggctagaccctccactataacactgaatagaattagagaaaacagctatcttgccgtgttctctatcatagaaggaagcattcagaattccactactaagtataatggtcactgtaagttttacatacatacctttcattaggttgagaaattttttctctaagcctagtatgctgatatttttaaacttaaatgagtgctgtatcaggggaacctgcccccagtatttcaacctaggttctttctattttccctaagtgtaggtcagcctgagaaataaagagaaacagtacaaagagaggaattttacagctaggcctccagggatgacatcacatattggtaggtccgtgatgtccacccgagccacaaaaccagcaggtttttattaaggacttgaaaaggggagggggtgtacaaacagggagtaggtcacaaagatcacatgctttaaagggcaataaagatcacaatgcaaagggtaaagcaaagatcacaaggcaaagggcaaaatcagaattactgatgagggtctatgttcagctgtgcgcatattgtcttgataaacatcttaaacaacagaaaacagagttcgagagcagagaaccagtctgacctcaaatttaccagggtgaggtttcttccccaccctaataagcctgagggtactgcaggagaccagggcatatttcagtccttatctcaactgcataagacagacactcccagagcagccatttatagaccaccccccagggattccattcttttcctagggtgttagtattatattccttgctaggaaaacaatttagcaatatctctcctacttgcatgtccatttataggctctctgcaagaagaaaaatatggctctttttgcccgactccgcaggcagtcagaccttatggttgtcttcccttgttccctaaaatcgctgttattctgttcgttttcagggtgcactgatttcatattgttcaaacacacatgttttacaatcagatttctacaatagtggtcccgaggtgacatacattctcagcttacgaagataacaggattaagagattaaagtaaagacaggcataagaaattataagagtattattagggaagtgacaaatgtccatcaaatcttcacaatttatattcagagattgcagtaaaaacaggcgttaagaaactataaaagtattaattttgggaactgataaatgtccatgaaatcttcacaatttatgttcctcagccgcagctccaacaggtccctccgttcagggtccctgacttcccgtaacagtgctgcacttttttcaaaatttgtttctccatatattaacatgataaagtggtttttctcttttattctgttaatatattagattacactgattatttttcaaatattaagtcagctgtttattcctgagatatacctcaattggtatatatttgatattttgttaaggatttttaattctgtgtttttgaggggtattggtctggttttcatacaagcacatgcttatcttgtgaaataagcagggattcttcccctcttctattttctagaagactttgtatataattgatattgactgaaatctcttaagccatatgagcttagactactgtttataggaaaaacttaactatggattcaatgtatctatatattaggacagggctttggttgttcttttttttcctttatctcaaatttttaaattttgtacctttgaatgaatttgtacatctcatcaaagttggaaattttagtaggatatatttgttcatcatagccccttattatcttttcagtgtttgtaggatctgtagtgagagctactgctttgttcctgatactggttatttcattgtctcctattcttgaccagatctctcttaaaaccagattttgctttcacttatttttctattacctgctttccatttgatcatttttctgcccttatagtcaatatttcctttctttaaactcattttgagtttaatttgctctcatttttccaggttataaagcattttaagcaacacattttcctctaaggaaacagccttacctgtatcctacacattttaaagttgtgttcttatttttatttagttcaaattatttatgagaaattatgttttacagggatattgtttaatttccaaatatttgttgattttctacatatttctactgattcctaacataattattttgtgttcagagaccatgttttataatatatcaatatttttaatttcttaacacacttgaaaagtttatgatataacttagaggatgtattatgtacactaaaaataatatatcttttcctgctcttaagtagtgctttatatagacctatcagttgcaataggtaaagttggttgatagtattttcaactttcttgttaaaaaatacaatttagaagtatttttcaatactatctcaagtatttttgagttatctgtatctttactgatttttgtctacttatgctatcacttattgaaaaagaatgttgaaatctgcaactatcaatgtggatatgtctatttcttcattcaggtctatcaatatttgtttcatgtactttgagtttcttttattagatgcatacacatttagataagttaataaagatttttattcttccttgattatttaaacctttgttatcatgaaatttacctctttatccttggcaattttccttggaatgtagtgtactttgatgtcaatacaatcattccaaaagttttatgcttagtgtctgtataatatatatttttccatctgttattgtaaattatctgtttctttttacctaaagtaaatttcttgtatgagcatacatttgggtcttgctgttttacctggtctgaataaactctgccttttatttggagtgtttgatccatttacacttaatgtaatgaataataattagatagttagataagtaagttttctatgtctttttcttgtttttgttttgctcctttgccttcttttaattcgatattttttataattatattttgtctcccctagtgatttatatgttagctgtgtgtgtatatgtgtgtatttgctctaaggtttaaagcactcatctttaatttatcaattctaccaccaagcactgttatatcacttcacattaatcaaacttataatagtttacttatttttccctactcttccttgtgctattgttatcacaatggtctagtgcctccagttaggaagctatggtaatcataaagttcatgctatgattcttttgcctcctattaatataaaaaattccagttcagcttgctttcaaatgtctggagtttttttttttataatgctttttctgtgtcttagttatctgaagtgggagtgcaagtcagtcttgtcagttagctttacatgatcaaaagcaaaattaactttaacatgatatattctttagaaataatatcttcataaacaaaaaataaattgacctgtcaataatgctagctctgagataatatttcagctgtattaaaaggtttacattaagatttgctaactttactccaactatgatcaacaaatcattataaatattttataactcatatttatgttagaaacatatggtcataggggaaaaattagaatatatagatgaagaaaaaatgaaactttcctcttatatcatacctagacatgcagattaatattttgctgtagaatttgaataggtatagttcatatattctaaagaattcatattagaaattttgagaaccataggcacagactatgaccaaataaaaaccaaaaaccaaaaacaccttctcatattcccacctccacctctgactccttaatttagatggtcattacttccacctaaattatagatacacttagcctcctacctagtttttgtcatcagttttgttttttcgtacctattctcattttgatcagaaggatttcaatcatactttatcattccatcacttaaatttcctcaacgaattctcaccaagattaaataaattctcaacttctcaatataacacacaacattttttggctctaatttcatctcttcttatttattacaaagcattacaaactctagccattttgagcacacatatgtggtaaatgcagcacccatctgctgtttgttctctgaataccctccgtacaaccccaccactaactctctttctcacacacttacttgtcttactgtttcttcttcctgctttacaactgatgcctagggttccattgttggaacactaagtatgtgggagttatttatatcctattgctcaaggtcatcaccaaggtctgattgcaaatattcaaaaattgcaacctcaggcataaatgggttaagatgaagttcaggcatctgtttgctttaggctgggttagttgtatttatttatttatttatttatttattttttgctcccacagttgccagtacactcatggttctatgataaaatattgtgctgtggtctaatattttccttacttctttgtctctctcactaggttgtgagttacttgagagcagatattatgttttccattttttaatcactagggtgcagtagaccatctggcacatattaactactcaatatgtatttgttgaatgaaataattaaaaccattactcatgtgataatcaaattggcactcttgatttcactggcactttatgttagacctctatattctttatctgtatctacaagacaacatcaatggtaagacacatcctccaataatattatgtgattctagctaaaaggaacataagaaaaattgtaactttttttctacttttcacactgaaaactgtgacatctattaaaatacttttacccaaaaccagaaatataaaagtgtatattcaataataaatattaggaaattgatgtctacagacatgtttcaaacatctcataaaagctcttttttcttttgccacttccaaattaggaccgttcttgtttttgaattcagctccaggtattcaatttagtcttcgagaattaagtcttaattatctcagtgatcatctcactgccttgcattctcaatttagcaattgatcacagagtgagcacaacatagcatttggacataaaaatcaactttaagttttgactacaatccactcagtgatttaagcacgtactgtggtctgagtccaaaaatatttcatattgataacagaggaacttttgtgattcgtttcaccttcaaactccagaatattagtatcccttaacaaaaacaatttgtattggataaaaatgtttggtataaattaggactcttcacagttcaaataataataatagtaataattagaaaacccaacctcacctaacaatgaatgtttaatgatatgagtgatttgttggctaatataaccagaagttccagaggatgaatggattatatttggctcagtttagcagctcagtattaccattaaagatccagtttaattttatttccctgtattccatagtactagcattatcccagcactgactttcttcatggtgtcaaaatgacttatagttccagacttcatatctttatgccacatctttcagaatgaaacaaaagttggctacaagtaggtctttgagaaatctgaaaatcatctttcctagaagcataattatttttgaagcttgactcaacttggcccttttatttgatcatatgcccattccagaaaaattatctgtcaacaaagaagtatcatatgctaacggtatagattttaggtccctgaatcaattactattgtggcatagggttacctcaacagggttagacctatcaaaaatcatctctggatcatggaatgaggcaattacccctaacccaaaaccaggccgtttttaaatagctaggaagaaaagtgagtcttggggataaaacatggaaatttagaaccagagctggaagtgatgaattcaaacatttttaaacaaaaataaaattccttaaaattagggttgacaaatttattgaataaaaatacttggcacccatttaaatttgattttcagataaacaacaattaaattttagcataagtatgtcccatgaaattgtacttgaaatctcatttagactgcaatatatgagttatttaaaatacattgtttttgtaaaagtacaaaaaaaagacaactttttatgggaaacaaaataaataaagataagacaaagactggctgtagttttcatttgattatttcagtcagtgaccacacatacatccagtaattatgggaatgttaggtaggaaagtcagttcaatgctcctggtcttaatgaagaggactcatccctaagtactacagaaggctcactctgccttcttactgattactaaaattgggaacagtttgctcagctctgggaggaagttgcctctcatgtataaagggcagtctctgccgttgcaggcaagaggtatcttgacccagtctgtttgactggatggataggctctctaactctgagcttcagacttaggaagcccatttcactctaactctaaaaaaattgctttaaacttagatttaattaataataggtgtgggccgggtgcggtggctcatgcctgtaatctcagcacttttggaggctgaggcgagtggatcacaaggtcaggagtttgagaccagcctgaccaacatggtgaaagcccatctctactaaaaatacaaaaattagctaggcgtggtggcacgcacatataattccagctactcgggaggctgagaaaggagaatcacttgaacctgggaggcggatgttgcagtgagctgagattgtgccattgcattccaggctgggctatagagtgagactcagtttcaaaaaataaatgaacaaataaataataataataataagggtgatagtccaggccccatcttttactccgttgtgctgtttatattttcacccttgattgcagaactttatagggaagtttatatgccctccttagaaaattcaacccaaattattctcgctaatttatatgtactggaactaagaggttatcaatatatgctacctatttatataaatggcataaattttggagtgtttactgatttagactttttgaaataaagtttaacctttatgggataatattaaacataagttccccatttttaatttattacaataaataaattatatacaattagtggatataaatattgagagtgtttctgaggatatataaaaatggctgcatcatgacaattactctcaggaatcaaaagagaagtggcactgaaacaggtgaaagaggaagtagggacaatataatgtaatagacaagaggtatggacctgagatatttagctgaatatgtgtacaaattcacatgtctggactctgttcacaaccaccaaaaaacaaccatcccaaaggaagacaaaacattgttctagaaatatagggatgccaggtggaaagatgaatatggaagtgtttgcagcaggctttacaatgctagtgatgtgctgtaatttgaattgccaccttgagtgggttttgcttttcttaccactgaagtttagatgacctgtgacgtggtttttcaaaattaacaaaacaagtacagagacagaatcatccagaagctttcaaggatattacattctggacatgaattcatgagataggaaccaccctcagaagtgggaacttttaaaataaagctattgcctcagcccatggtgggaagtttacaaaaccagctgcactttgcatctctgggtctaacaaagatcacatatcaaagcttcatgaccaaattaatgtgtagcttatccccctccccaaggtctttcccttggttttattattactgacaatattgtaagagcagtgtgaaatggccaattcacacatgtgccacgttttgcacactgcctgaacctgctggaacatgattttcctaagaatgatgacagtaataaacatcttctggcagaggcttgcaaaacctgcacccattttagtcactcagtaatggctcataaaattctttgagaactgcaggagaaaaacaatgtacatactcatgcataaattaaaactagaagtgccagctcaatggaactcgacttctcacactctgggacaactgtggagcaattaaaaataaacaaacccatcagatgtaggtacagccaacggtcatcagagaaagtgctctctgtttgagatcaaaccattaaccagtgccttccttgagctgattccctctttggtctgtgaaaatattcaggatactttacataatccttcctgatgagttctcttacaaaggcaatgtcaatgtgaatggatgagaagaaaaatgctcatcttgatttccctttacatttaaggatcattttctgcacaaaatgtaatataagcataaacattcctgattcccttctttacataaaagtttcaagtttgagctctgtcattttcatgggtgaacaattcagaaatgctctttattttgtcaagttttaaagaaagaaaataatcagaaatacctaaaaaatattctcatagaactcaaaaaatcattagttcatagagcatttctagcaatactttagaatcattttctcagccctgctcactatgagtaggactctttacagttttcagaactgaaaaaaaaaaatcggttttatggtcaagtttccatacttgtcttagcaattgaaatcttattctacagttatttggaacgttctcaggtggaaagtaatgggtaccagttttatctgtcatctaacataatatttggcagttgatacaatgtggtgtattaatactcccctcaaatagcaagatgataatttgggaatttttccccagatctggaagcaggtttagttggtcctgggatagtcccaaccaacttgccagagattgctttagtcatggtcatgtgaccaattctggacaacaagccatgccttgaggtttatgacaggcccttgggaaagttcttccttgcttttaagagagaataggaaagctttatatttctccccaatggttgtgaatgagaaaacatgtagcccctattactttgggcatttgtctcaaatctatgaagaaatgagataaagccaattgagagagagtccaatgggaagatttttgaggtgctagtattagtccgttttcatactgccataaagaactgcccaagactgggtaatttataaaggaaagaagtttaattgactcacagttcagcatggctggggaggcctcaggaaacttacaatcacagcagaaggcaaagagcaaacaggtaccttcttcacaaggcagcaggaaggagaatagtgaagagcaaagggggaagagctccttataaaaccatcagatctcatgagaactcactcactatcaagagaacagcatgggagaaccacccccatgatccaattacgtccacctggtctctccctagatatatggggattatggggattacaattcaagatgaaatttgggtggagacacaaagcctaaccatatcagtggtggattagccaacactaaaccctacctatttctgatttccttttgtattagctagtaagtaatctgttcttttaagtcattgtttcaggttttgtcacttacagtaagaggcagttcaaaagacttaagaactttacaaaatgtcctttcttattacacagtgacttatggggtggagggttgcagatgctcagttgttaagtgtatggaccaaaatgacatatggcaaagaagcaggcccattagacaatgaaagaataatgatgtaagaatggcaggctctttgtctcagagaagtggctacacctgataagaatcccagttctaccacccatgtgtaggccctcaccaaatttttctgcaactctctagggtttaatttctaatatttttttctctatatcctccttcttgactctgcacctgctattttcaattacagcccatccacctcacttgttgtgtgagcgcacacacacacacacacacacacacacacacacacaccacatcacagagtattctgtgatggtggtgtcccagatgatttggggaatcacaggaagggaaagtgagtccttcctgtataaataactgcatacatactttctgttttttctcttgtctcttcttacctattcagagccacctaccaaattctttttatgttttatgcacatgaattttatccactcctaggacataaaacttctttatttctactctaagcaatacgccaaagaattttcccaataaatgttgatcttcttctacaaggactccttttccaactgcaaaatatatatatacacacacatatatatgtgtatatattcatatatgtatatatacatatatgtatgtatatatatattcccattgaaaagtgcacttctttttcaaatttatgtgaaaattggcttaattaggaggaagatgttcttaggatactgcacctacaaaataaaattcccaaatatgaccaggagcatccttctgaatcagtgtgactctcaactccaaatgaagtttaggttttgcctgaccccttcccaagtagaaaatgtttctcaggcaacaggggcttttcccacaaaaaaggtcagttttgggattaaagagaggtacaaatgaatggttttaggagtagatacatcttaggtaagaaatagagaaaaggattcatacaagaactgtaaggctctgaattcccaggagagtatgtagagcactcagtcctgacagtaagcaccctctttgaataaatagagtcctgctagatggcaggattccaagctgatgctttgagaagaaagacctctggaaaaacctcacaatattaataaatacttgtcattagataatttcagctgcaaaaaatgcttcaaatgtctcttccaatataattcacctttgttctagatatcaaagatctcagaaaagcagttaagactatgatgtataagtcagcacttaaaagatcttaccttttaattaaaggttataaaaattattcacactcaaaatatcaactcagaaaaaaaaatctcacaatttgggccagttttgttatcctttagatagcactgaagtatttgcttattgcaatagtatagagtgtttctatacaatcacatatttttgcagatatagaggcagcacacacacagttgttgattattaattttcaaaaagaatataattaatagcttggaatcacagaatgaagaatgtaattaatagcctggaatgacagtattgttgagtgctaagaaagctatggtcttcagactggcgaaagtggcaaaaccgcatctctacaaaaaatataaaaattagtcgggcgtggtggcacacaactgtggtcccagctacacaggaagctgaggcaggataatcgcttgaacctgggaagcagaggttgcagtgagtcactgcactccagcctaggcgacgaagcaagactgtgtctcaaaacaaaacaaaatgacaaaacaaacaaacaaaaacacctatgatcttgttttggttctaaaagtttcaaactttacctttcccaggatgccttagttttctcattggtaaatgaggtaactgggtgttctgttcgttatgtaactcacagttttaaattattagatctgattttaatgagcttgaaaatacaaatcaaggtatctaatctcttttgctctcaggtttttcaactataaaagagaattgtaagataccagtagtgagtgtatgcatataacatctggagccctttttggagaacaatgcttacgctctccccaactcctgccccacccctggcatctcggttccaccgtaaactcattattagttcaggtggtttgagagaagttgatcaggttctgtcaagggaaacacatgacctgtcctgaacaatctgaccagtgattagccatggccattgttacagaaatagatatttgacccaggctataccaattaatattctcttaagacttttgctggacctaaccagaaacaaaactccctttttctgaggtgtaagcaatgagagaaatttgacttcaatttgccattggccacgttgccactacttgtagtgagaatgaaggtaaggtgggagctgagagagagagaacatttcatttcgaatcccagaattcaaatgcctaaagcctattttttgcttgtttgtttcatgagccaataaattttccttttccttaaggtactaattttccttggatttctgtcactaaacactgaaaatattgacagacatattaccttagaaatttatgaaacgtgggaggagccaagatggccgaataggaacagctccagtctacagctcccagcgtgagcgacgcagaagacgggtgatttctgcatttccatctgaggtaccaggttcatctcagtagggagtgccagacagtgggcacaggtcagtgggtgcgcccaccgtgcgcgagccgaagcagggcgaggcattgcctcactccggaagcgcaaggggtcagggagttccctttccgagtcaaagaaaggggtgacggactcacctggaaaatcgggtcactcccacccgaatactgcgcttttccgacgggcttaaaaaacggcgcagcgcgagtttatatcccacacctggcagggagggtcctacgcccacagagtctcactgattgctagcacagcagtctgagatcagactgcaaggcagcagccaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttgtcccagtacgcagctggagatctgagaacgggcagactgcctcctcaagtgggtacctgacccctgacccccgagcagcctaactgggaggcacccccagcaggggcacactgacacctcgcacggcagggtactccaacagacctgcacctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacacagttcctcaccagcaacagaacaaagctggacggagaacgactttgacaagctgagagaagaaggcttcagacgatcaaattactctgagctatgggaggacattcaaaccaaaggcaaagaagttgaaaactttgaaaaaaattgagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacgttcagattcaggaaatacagagaacaccacaaagatactcctcgagaagagcaactccaagacacataattatcagattcaccaaagttgaaatgaaggaaaaaatgttaagggcagccagagagaaaggtcgggttaccctcaaagggaaacccatcagactaacagcggatctctcagcagaaaccctacaagccagaagagagtgggggccaatattcaacattcttaaaggaaagaattttcaacccagaatttcacatccagccaaactaagcttcataagtgaaggagaaataaaatactttacagacaagcaaatgctgagagattttgtcaccaccaggcctgccctaaaagagctcctgaaggaagcgctaaacatggaaagggacaaccggtgtcagctgctgcaaaatcatgccaaaatgtaaagaccatcgagactaggaagaaactgcatcaactaacaagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagatacacataggctcaaaataaaaggatggaggaagatctaccaagcaaatggaaaacaaaaaaaggcaggggttgcaatcctagtttctgataaaacagactttaaaccaacaaagatcaaaagagacaaagaaggccattacataatggtaaagggatcaattcaacaagaagagctaactgtcctaaatatatatgcacccaatacaggagcacccagattcataaagcaagtccttagtgacctacaaagagacttagactcccacacattaataatgggagactttaacaccccactgtcaacattagacagatcaacgagacagaaagtcaacaaggatacccaggaattgaactcacctctgcaccaagcggacctaatagacatctacagaactctccaccccaaatccacagaatatacatttttttctgcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccaccagagaaagcaggaaagatccaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaaaaaaagggagaagaatcaaatagatgcaataaaaaatgataaaggggatatcaccaccgatcccacagaaatacaaactacaatcagagaatactacaaacacctctacccaaataaactagaaaatctagaagaaatggataaattcatcgacacatacactctcccaagactaaaccaggaagaagttgaatctctgaatagaccaataacaggatctgaaattgtggcaataatcaatagcttaccaaccaaaaagagtccaggaccagatggattcacagctgaattctatcagaggtacaaggaggaactggtaccattccttctgaaactattccaatcaatagaaaaagagggaatcctccctaactcattttatgaggccagcatcattctgataccaaagcctggcagggacacaaccaaaaaagagaattttagaccaacatccttgatgaacattgatgcaaaaatcctcaataaaatactggccaaacgaatccagcagcacatcaaaaagcttatccaccatgatcaagtgggcttcatccctgggatgcaaggctggttcaatatatgcaaatcaataaatgtaatccagcatatagacagagccaaagacaaaaaccacatgattttctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcagttaggaaaagaggaagtcaaattgtccctctttgcagacgacatgattgtatatctagaaaaccccattgtctcagcacaaaatctccttaagctgataagcaacttcagcaaagtctcaggatacaaaatcaatgtacaaaaatccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatgtaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacacggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgtacagcaaaagaaactaccatcagagtgaacaggcaacctacaaaatgggagaaaattttcgcaacctactcatctgacaaagggctaatattaagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaattaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattcagaaaatgtggcacatatacaccatggaatactatgcagccctaaaaaatgatgagttcatgtcctttgtagggacatggattaaattggaaatcatcattctcagtaaactatcgcaagaacaaaaaaccaaacaatgcatattctcactcataggtgggaattgaacaatgagatcacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataataaaagaaaaaataataataaaataaaattaaaaaaaaagaaatttatgaaacgtttagttagatacactgtgcaaaagggttgtttaaaatgcaagtaactatgcaaatatatgacagctactaatatttttatttttctacaataaaatttagaaaaatacttttacataagaataaaatgctatcttaatcaaaagcagttacaaaacacctaattctgttcactgttatcctcgaggctttagggaaatttgttttatttatttcattgtcaagaagcccagttaatagctatggatttgtttctatattatccagtcgctaagtaggaagtaggaatacattttccttacctcgtaatatagttttcactgtcttttctagcatgcttataacacttcatgcttttagaagaaaggtgctaaatgctaagaattagtattcaagtgacttcaataagaatgaaagtagagagtttgtaaggtatgctaaatctacaagattttaaatagggtctcacagctttaacccacaaattctggactaacccacttcaacaaagagtagtttcaaaacctagtttgcaaaatgattacatggttaatgcaggattaaattttctttcaattataagactgaatctggaaaatactctacagagaatgaaggaaaaaataaatcctgcaagaggtgcatttggtctaaagtgcttttaaatatgcttcttaattgctgggggctattttgctcttcatctaatcattgtctgaattactgaaggtcaacttatctgataaaataggtgagctttgtggtaatgaagtcagataatgtcttatattcgtgtcagggtaggcatcaaatgggcaatgtatttaactattagtatggagtttgcagactggaatactttcatctaggttttttatatgaagccagttcattgaaataagtaaaggtttcaaaatgggaaagcatataagaaactgtggctttaactgtttaataaaattgcttgctatttaagtaaaggtaattaaaagtgtaatgccgtggaactattacgcacctactcaaaaacgcgtggatttttgttttgtgaaagagccaatatcttgaagaaggggtaggcttcacaatgagaatcccatagatacttttaaagagctggagattaactcatttaaataaacagtcattttatggctttttcaccagggaggccagcatttccttggggttcttgaattagggagttccacaccaaggttctgtaaattagctatgtgggtattcatattatcaacaccttcaccgcagcaggaggccccacatgggcaaaaatcaaagaaatgtagtaatcttctgactatagcagattactctgctatagtacttttgcttctgcctagagcacttttggttttgctttgcacctgacttttcaaaaaatatttctttaaccactatttgtttgattctgagtaacatgtattggaaggccaagtctatctgcatgccttttcaggtgttattctgacagaggagtttttatacatgttggttttatagcataaaatatgaaaatttataaaactgctcagtacaagtttaagggcaggtttctgtaaaacacagagatattttaaatgaaatatacaaatgtactggctccttcatgatttttttacatgaactaaagcaaagctatattcacatatgaaaaacatccaatttcatttcatcctcccctccccaacatatggtaagtatttccttggtttctaaatctgatgcatttccaaatacacttggggaagaagtgtaagttactatacttccatctgatttttctcagagaaatttgtacaacataagttttacagaatggatgagttttattaaaagaaagagcatttgtccgtgcaatgcctaaaaaacctgtgaaagtgcaggtcatagagagaaaccatggtattatttgctggctttctgtcaacaagaaacttttccatcctcatgtatatcctgaagtcaagtgcacatttttagtagcaatggtccatgagaaagcaataggctatcctgggtgtctgggccactgggttggtcaattaaaggagactgttgagtcatgcattctaccttgtcacatttgtctggttttgtttttctatagaaaatcaaagcaaacaaagcagctctcagtaatgcattctaaaattgtcatgaattaactgacctctgtagaaatgtccttttcctgggtcaattcagcaattttgtcctgcttattgttttctaaatacatcagtttcattttgtgttgaacatcaaagccctcatgataagtactatgtttaactacaaggctgagttgctcaggacctgacaagtcatgaagcattagtagatgattggttcttcccgtcttggaactcagcctaatacatacagtatttaaatagggaaatcgccattgactttgtaatcccttgtgtgacacttgttctgtgaacagataaaggagaagtaagtcaaatacacatttgttgggaagtctccactgtctcttttctccccaaaggcaggaactgtcagcattggtgacctcaagctagcccatgttctgatattatggtgcacattcccagggaggattatttggaaggacttttgtgaagggaaacatttcagctgctttttacaagcactgattgcccaggacaaagtaactgactgctacaacattgaagctgaaggacataaacatactataatatgttttgtcataaacaatcacagattaaggccctcttcacaggtgattgaacaaaatgaataacagaatggagacttgtattctaatgcttgttgctcatgtaaactcatgttctgcattttagaatttgttgaagccatagcttctgctttgggaataagccacattaatcaggtcattcctttaggtgtattctgaagtagctacttttggtgattaaacttcacatattatattaggtaacacagcatgctgttaacagcatgttatcagtaaaggcaagagaaagcatttattttagataaagcaggctaacgtctgtcaactataacactgctctctgatatcaaggtaagagtaagctacagaatgccatcagcaatagcaaacatatgctgagtgcctactatgtgctgggcaatatatcagatgctgagaagagttatattataattcataagggatataaaatagcaagcaattcaaagtagtaaatagataatctgccatatattttagaaatgtattaagacagaagttgctctaacatttgagagttaaagcaactaaagtccttgccatttatgagacttgatcaagcatacatagtctgtatgaagttttgaataaatctgttattctatcatctatgtagtgagaaactaggaaaataaaccaggagttttgagatctttaatccaagagataccttgtagtttgggcacaaactagctttccagtttttttcttctgggactagtattatttgcatttaagagcttcaaggaaactttgactgataactccaaatatgagttttaagctagcataaagtatcaatttttaagcaatagacatcatgatatttttcatcgcctttcacatgatggcataagtgaagcccaaatggaagttcaatgattccatttcagctataaaagattcaggaagattagaacctcagtgactttcttgtatagtgattttttaaaaatatgttttgctgaacgagagggctgtcatgaattaaatgcaactctgcatttagttagtattcaattctattcttccaataaataactggatgaaaatcatttaaagaaaagcccttctctttaaggaaacatctttagaccatttttatgagatttctctagcagaccaacttgcaacttctagaaaaataacccaaaccatgtaaatgtactaaagagagatctccagggaagcacaacctcttagttctgtctttatacagctcgtggtgaatatggagtagaagaaaattgtggtttcaacagaattcaaacattattgtatcggatctgaaaacatttattcattaaggctaaaataaaggaaaacattttgaaaaataacagccagtaatttatgtctggctgggctagatctaaacttgagttctggccattttcatgtatgttatcgtgaatatttaccatgacaacatctgcatagcattacctactcacttctgagtatttaatgtacatactcttaataaacatgttccttgtggtctgttatatatatttttaagaccacattaaaagaatcagaagtggaagagatattttcaaaaacttaaacatggacatttctcatatggagttttgaaaatgtgcaatatttgctttaataaccagagaccatattataaaatgcctgtagaaacacagtgaatgaaaaagtctctaactttaatggtttcaacaaagtgttatattttaggaaacaatgaaatggaactcctatgaatatagatagtagaaagaatggagaaagtgtgtatctattcattatttgatggagtcctgatattttcttgtaaagtagctgtaaaagaagtcctaatataaatctgcaagtgaaaaaggaaagcatgacatcagtctctcttatagttttgaaaatgctaaagcaaaatcaaactgacaaaacttgaagagctgctgctaaaattggcataatagtgtttaattgaaaaataatgtgatgtaaggtaaataatcagaagagcacgtttccaggatttcttgccctcaaagtaatacagataggacagtacacatatacggttatcagtttggaagaacacttgaatgaaggcactgaaaagacagaaataatggtgtcttcttttgctttgaagcttcctgattggaatgcagtcctttagggtgggagaatctgctttatttagagaatagcaattcaaaccattcttttccactggaaatatttgtcacaggaagattttcccatagtaaaagtgttttgttaataaacttttttttttatgttgaggtcccttacatgtaactaactggaaccatgctttagccaaggttttaggcaaacctcggcctttgaattgtacaggcttgacatgtcattgcagagacacgtcacactgcattatgctgtcgctttgcatcccttggcatttcactgacatactgcaggctcttgttctacttttttgtgctgctttccacggtccccattacaggctccaagacccaacaactcctgcaaaaattgatagcattttttttgcctgtgaacaatcacttccttatttgaatgactttaaaaaaatgagcctttggttcttagtgtatggaaaaaaagtttacttagggtgctttcagcctattcaaatcaccagcagctctctgtatccagatgtaaagcggggattccaaatctgcagaaataaactgcatgaaacatattaaaataaaaataagttgatttaagtaggatataaaaattaggtttaaagcgcaaatataggtaatctccttatgaaaaatacagtattttatgattacagaagttactcatttttatagtagggagctttggcaggagaggaaagtaagcaaaatgaaaaaattaaaaatcgtgtaattcccacatttaaaaatagctgcccatcattttgtctatttctatttatatctagagcgatactgacatgtaatgcacacacataaatgatatcacatgcaaaaaaattttaacaagaaattatattataaacatgtccccggtcattaacatttgtgtaaaacattatgtccatgtattcttattgtttgtgtggttatgctatatttccttaagataaatttctcaaagaagaataacatttatctagatggatatttaccaaattccacctcactccctcagaatttgatgcctctttcccaggtccttatgaacattctcaatgacagtgtttaaaagtgttggttttcccttttcttcatcaacactaggtattgccatttgttagcataaagagtataatctttgccattctgatatatagaaaaacagttacatatcactttaatttgtatttcttcaacagctagtagagcaaagtcttttattacatgtttctggtcatttgtaattgcttctggcaacaaacaaacaaaaaaccttaagcaattttttaaaagcccatgacattttattttaaaggtccattttaaagcaaaaaagtaaaattgaatcattgccataatcagattacttttaattaaagcatttcacacctagagccctcttgggaaggtatgaagtttttacttcaactaataatccattcttctgtaacctaaatggttcctatttgaacaatgaaacatgcattattcctttaggacacatgatcagtagcctcgggataaaaacaaaaccagaaatattcagtgtttggatcataaaatctgtctcttctccccagccccaccagtttctgtggtatatcattatggttctttctctacagctttctgtatctccctatttctagcttcctttttcatttcaacttttatttcatatctctgcagtcccatgaagtaagttcaaagtcttgctttcttacatatgggatactttggaattgtttttccttaagttttatttcttgctcccagtgagaacaacacagatgactaaaaaatgagattgcatttcttcaattattgcagaaaaatacctatctcatatgcacattgaagatttttaaagatttatctttttgaagtaataaaacagaagataactgctgtagactttatcatatgctaggaacttttatgcagtatttcatttaatacacacagaagtgatatgagattgaagctatagctcccatttaagagatgagagaactgaggcctgaggacttaggtaaatggaattaagaatatctaacccaagggtgttttttacataggaatcaaaacaatgtaagtgaaagtgtgtgtgtgtttctgtgtgtgtgtgtatgtgtatgtgagtgtagcacataattaaaactgaaatatattgttaagtaagtgctcacttaaattctctgccaggaaagcaaaacagaagtttcctcatctcttcagatgttcgtctgttttgtctttatttgtctcaaatctttattcactttgttaaagatgtttcatagaagtatcaatatttatctgcctttcaaggctgctcctaacccacttacccattcacccaagagcagagtccttgggtgaaatgttatacacttaagatatatatcccaagaaccatgacaaacaggatgttgggttgtataacatacgctgcttccaaatgtagccttggaaaataatttttttttttttgagatggaggttctccctgttgcctaggctggagcacagtggcaagatctcagctcaccgcaacctccgcctcctgggttcaagcaattctgcctcagcttcctaagtagctgggattacaggcatgtgccaccacgcccggctaatttttgtatttttggtagagacagggtttcgccatgttggccaggctggtctcgaactcttgagctcaggtgatccaccctcctcggcctttcaaagtgctggaattataggcgtgagccactgtgcccggccagaaaataattttttaaaaatagtttaaaaactttattttactaattcttagtaagggaagtaatgtaatgtaaatgcacacagtattttaaagtttacaaaccacttctatgtatctacttgactctaatgacttagacaagaaggcgttattttctttcttgagttgacgaaactatagcacagagataaagtgacttggcaaaggccttatccagctagaaatgtgcaattccagacttgcaatggggtcctctgaacttaaatcatagttaatcccttacctttttctatgcctcagcagtagtactcattcatccatttattcatgctttcagagaataattgttgggcacatagtatgtattaaggtcatagtaagacttgagagttaggggcatgaaaaacctagcctttactctcttggaacttgcagtctagttcatggtttctacatttaaacccaactagattatatcacaatatatgttccagaagtgtcccagatttggaagagtggaggaaagaggatccatgcgtctgtgtagaaagaaagacatctttaggactgagtcagattttaaaggatttgtggtttgtcaggtattaaggataaggaagctattcctagcagacctaatagcacatgaaaagtcatgacgaaaatgtctgatggggtatctgtagcaggatgggctagaaagttggctaaataaaagggactgagatgaacaatatgacatgagtttgtagatatagtcaaaccagattatgggggcttgaaatcctagcataagtacatgagttctatatcatgtagtgtggatgtgctcacatggataagtgtgtgtgtgtgtgtgtgtgtgtgtttctgtgtgtgttggagggagggaagggtgtaacagtttttgaacactcctatccattatctttaaataaagaacctcatttactcttcatgccaagccttttcagatggcattattattcccagttgcagttgggagaattgaagcttagagagtaaaaaaaaaaaaaaagtccatggttaccctgcttacaaattacagaactggtgttaaacccaaggtatatctgaacccgttgcccatgctctttgtactgcactactaaagatttttttttaaagtagaagaccaatataattagacatatgttatataaagataatttgcaacattttaagagaaatgtgtaaagatgattgtccaagtgagaagggatagatgcctgaaaatagagatagtaggtggatttgagaaatacaaagaagggtttggggaatgatcataaagagctatgtaggataacaactgagaataaatgacttttttttttagcttgaatggctgttataatgtgttgtcacttatttactggagaagattcaattattactagaggacattcatggggaaaaaaagagatttggaccaaaaaagatgttattagtttttaatatatcaaggatgtactccatgagtgacatttgttaccgattactagaaacagaagtgaggacagatgccagggtcagtaataggcattaatgtggagataatcattgaagtgataggcatgagtgagctcctttaaggagaacacgagaaggaaagacaaaagatctagaattgggggaaaacctgattttaagatgtaacataagatttgtatattttaaatcatggtagatttttatagaagaaatcttgatcaatattttaaaaagaaaggaaaaaatataaaacatattgctagaatggacactaaataacatgtcaggaataagatcacaaatatcaataattataagaaaatgtaaaaacattttatttgttcattaaaaaaaaaaacaagattgtcataaagaccaaaaggaatatgtgagctgtatgctatttacacagaggtgcagctgaaaaaataaagaaacaaaaatgttaaaataaagaaagaaacagatatggaataggccattgtaaatgaaggaaagcagaactagcagattcaatatcagtcaaagcagaatttagggcaaaaactgctgagtgggagaaataagaatttatcattttaaataaaagtacaattcacaaaacttacatgaccaataaaatattagtgtgtagaaaatatactattaagcataaatcaagttaaatatgttagatattgtgagaaaactatccctaaccatgttttccctgtactctcacaccacaacaattattaacacagaagacttctgcgtccacatgagtggaggtttttttcccaacacaccaagcagcggtcaccagttgggtgtcctctaattcagtctcgatactatctaaccagagacagtgtcagatgtgacaggttgacaagttgaaggctcacttccctaggactcccctccccccacaccactgacaccagtcacgcaagttgggcctctggaacttctgacagaccggcttcaggttggggttcccatgaccccctctttcggttcgattaatttgctggagcggctcacagaactcagggaaacacctacttatatttataagtttattataaaggatattgcaatggaaacagttgaagagaagtgtaaagtgaggtattataaaagggctatggagtttccccgccctccctgggctcaccacccaacaggaacgtgttcagctatcctgaagttcaatgaaccctgtcctcctgggtttttatggaagcttcatgatgtcagcatttcttcctccaggtataggatgagaccctctcatgggagaggcttaaggcccaaattcagaaaggcagggaaatattagagttctgcctgggggcaggcgaaaggagagcaagagaaggtcagaggcctgcccctgaagccccacacacccaacattataacaaaaggctataataagggctataggagttatgagccgggagccatggatgaaaaccaatctgtatcataacaccgcagatggaaggagaagtaaggagaatctgacagaaccgtaatcatactgaaagactttaaaattttctctctgaattttctagaccaagatggcaagaaatatatgatactaataatagataattaaataatataattaatacatttgatgagtgtttttatgtgtaaaatttaacaaacagaaattcacattatgtaaaaattcattttggaatgtggtcgtttgaccataaggaattaaaactatgagtcacaaaaatgctaaccacttaataataaaaaatctagtaagttaagatctaaattagcactttaatttactcctgacttagacatagacactgaaaatgcagactagttaaattaggcactgtattaaatctatgtctcaaaaacttcacaatgcagctaaagcaacattcaaaggaaaattgataaaatgtatttgtttcaaataaggttggcaataatcagtaaactgcagaagaaaataagtttctcaaaaccatatgaatttgatgctaatgttaccttcatcttataaatgaattaattgtggctcagaacctataaaaccaatagaaaatgaccaaagactttggagttagattttttttttttcttttttctttttttgagacggagtctcgctctgtcgcccaggctggagtgcagtggcgcaatctcggctcactgcaagctccgcttcccgggttcatgccattctcctgcctcagcctcccgagtagctgggactacaggcgcccgccaccacgcccggctaattttttgtatttttagtagaggcggggtttcaccgtgttagccaggatggtctcgatctcctgacctcatgatccacccgcctctgcctcccaaagtgctgggattacaggcgtgagccaccgcgcccggcctggagttagattttaaatggagtcctgattgcaccgcttactacctaggtgaacctgagaaaattgcttatcctacatgaatctcactttgttcagaaaagtagagaattttgttgtgattaaacaatattatctgtgcaaacttcttagaactgagcctctcatatgggaagccctaaaaaaattctatttacgaggtaaagcacaatttacaatctcaaaatacagtaggcagacaaacttgcacttgaactcctattaatcattacactattcttttgacataccataaatatattggcaaagaagtttatgaatcactactataaaactatgttaaatcaagagcaaggccatgttactggataaaaagtatagattttgattctccccaaattaatctataaatttaacaccttcccaatcaaaatctcagtactttgaggaggaaagggacttaatatttagcagtttttcataaaaaataaatctgtggccgggtgcggtagctcacgcctgtaatcccagcactttgggaggccgaggtgggtggatcacgaggtcaggggatcgagaccatcctgaccaacatggtaaaaccccatctctactaaaaaatacacaaattagccaggtgtggtggcacgtgcctgtaatcccagctacttgagaggctgaggcaggagaatcgcttgaacccaggaggcggaggctgcagtgagccaagaccactatactccagcctaggcagcagagtgaaactgtctcaaaaaaaaaaataaagaaagaaagaataaatttgtaaatataaatggagggagagagagactcctcttttaaggaaacagtaattatagcaatgtgagtttgcagaaataggcactcaggcaaatgagaaaataaaattatagaagcagacctcagtataaatggaaatgtatcatattttaagagttttattctaaatcagtgaggaaagaccaatgagtgttattggaaacttgttaaattcttacctcataccatatttcaaggtaaaattttattaaaatttaaatactgacgaaataatgaaagctctagggtagtagatagtgaaatatatcctataagtaccaaattgacaggaaccattctacctcaaaacaaacttctacttcaccaaaacaaaataaacaattataacaatacaaatctcatgctataaactatcaaaatatagacagcaaactggtaaattatagtaaccatgtatgtgacaaaataggttaaaatccttaatatttaaagatctcctagggcatcaaaaagctaaatgcctttttcctggctcaatttcagcagtagacaaatggcttatagagaatattattaaaagaaaacacttaaatgtccaataaatttagaaaaaatatgtttggcttcaatagtaactatatatattatatatatatataatatatatattatatatatattatatatagtatatatatataatatatatactatatatattatatatagtatatattatatatatagtatatatatattatattatatatatatatataaattttacttttaagttccaggatacatgtgcagaacatgcaggtttgttacataggtatacgtgtgccatggtggtttcctgcacctattgagccgtcctctaagttccctcccctcaccccccaccgcccaacaagccctggtgtgtgttgttcccctccttgtgtccatgtgttctcattgttcaactcccacttatgagcaagaacatgcggtgtctggttttctgttcctctgttagtttgctgaggatgatggcttccagcttcatccatgtccctgcaaaggacatgatctcattcctttttatggctgcatagtatcccatgatgtatatgtaccacattttctttatccaatctatcattgatgggcatttgggttggttccatgactttgctattgtatagagtgctgcaataaacatatatgtgaatgtgcctttatagtagaatgatttatattcctctgggtatatgctcagtaatgggattgctgggtcaaatggtatttctggttctagatccttgaggaatcaccacactctcttccacaatggttgaactaatttacatttcccccaacagtgtaaaagccttcctatttctccacagccttgccagcatctattgtttcttgaccttttaataatcaccattctgactggcatgagacggtatcccattgtggttttgatttggatttttctatgatcaatgatgttgagctttttttcatgtttgttggccatgtaaacgtcttcttttgagaagtgtctgttcatatcctttggccactttttgatgaggttgttttcttcttgtaaatttgtttacgttccttgtaaattctgaatattagacacttgttagatgggtagattgcaaaaattttctcccattctgtaaccatatattttaatcaaatcagtaataaaatataaatttcggggtttcagtaatgaaaaagaataacaatcaccatattatatgaagtgggaaaactagttgcccaatacactttgctgagactaaataacttaccaacagttctatgggctgtttatgtaattatttatcaaaaatttaaatttacatcactcttaactttaaaaattctacgaatagatattatactagggaagtctatccgttaggatgcttttgaaggcaaataacagcatacttaacctcatattagcttaaactataaagtgagtttaataggtctatcttagacaacagtatcttgcttcaagttaggtgtgaattaacagctcaagagataaaatggcaacaacatttcttcctctgattatatctgcttcatctgcatgcagttttgcattgggcaatagatcttgtgtttcaatactgattggtatgaattccaaaaggaacattattctaggttcaaatccagcaaagaataaaaattctgcttgctttataactaaactaaaagttgtgaaattgagactttgggttatctgactcaaaccatgtatgatacatatgtacattatatatatatatatatatgtatgtaatgatacatacatacaatacaaagattgaattatatatgtatcagtttatacttttgttcttatttcaactgtaatttttttcaagtgatgggagagaattgttaaaattatatctgagttagacaaagagtattcccaccaacatttttctccctcatccttctcctcttcctttcctaattacagacatatctcttttttattgtgcttcattttattgcacttcacaaatactgtgctttttacaaatcaaaggtttgtggcaaccctgagtccagcaagtctattggcaccattttcccaatagcacgtgctcactttgtgtctctgtgtcacgttttggtcattcttacaatattttaagctttttcatttcatatttaggaaaaatatgttaggcttcaatagtaaatatatattatatttactattatggtataagtatgttatgttgtggttatcttgtggtgacctgtgatcagtgatctttgatgctactattgtaattattttggggtatcaagaagcatgctcatgtaagacagtgaacttaataaatgtgtgttctgactgctctaccaactagccaatgcaatctcccatctccctccctctcctctggcatctctatctcctgagacacaacatttaaattagaccagttaataactttacaatggcctcaaagtgttcaagttaaaggaagagtcacaaatctctcactttcaatcaaaggctagcatgattaagcttagtgaggaaggcatgtcaaaaacccagacaggccaaaagctagagctcttgcactaaacaattagtcaagttataataaagaggaaaagttcctgaaggaaattgaaagtgttaccctagtgaacaacatgaatgaaaagaatgtgaaacagccttactgctgatatggaaaaggttttagtgatctggatagaagatcaaaccaggcactcccttaagccaaagcctaatcaaaacaaggccctaactgttcaattctatgtagtctgagagaggtgaggaagctgcagaaaaaaagttggaagctagaggaggttggctcatgaggttcaaagaaaaaagccaccttcatcacataagagtacaaggtgaagcagcaagggctaatgtggaagctgcaagttattcagaagatctagcttagataattgttgaaggtggctacactaaataaccaattttcaatgtagacaaaatagccttctattgaaagaagatgctatctgggaccttcatagctagaggggagaagtcaatacctggcttcaaagcttcaaaggggatgatgactgcattagggactaacgcagctggtaataaagttgaagccaatgttcacttaccattcagaaaatcctagggcccttaagaattatgctaaacctactctacctgtgctctataaatgaaacaagaaagctgcaatgacgacgtggtttatcaaagactttaagcccactgttgagttctactgcttagaaaaaatatccttttcaaaatattactactcattgaaaaggcacttagtcacccaagagctctgatgaagatgtacaaggagatgattgttgttaacatgcctgctaacatatttattctgcagcccatggatcaaggattaattttcacttacaagtcactctttaagaaacacattttgtaaggctacagttgttgtagatagtaattcctctaatagatcagggcgaagccaattgaaaacctcctggaaagaattcaccattctagatacctttaagaacatttgtgacttatgggcagaggtcaaaatattaatattaactgcagtttgcaagaagttaattccaaccctcatggatgactctgaggggtacaagacctcagtggagaaagtcattgtatttgtggtggaaacctcaagagaactagaattagaagtggagcctaaagaagtgactgaattgctgcaatcttatgataaaatttgaccagatgagaagttgcttcttacggatgaacaataaaagtgtttcttgagatggaatctattcctggtgaagatgctgtgtatattgtttaaatgacaaccaaggatttagaatattacataaaccttatttgataaagaagcagcatagtttgaggggattgattccaattttgaaagaagttctatggataaaatgcaagcacacagcttcacatgttacagagacatctttgaaaacttcattgttgccttattttcagaaattgctacagccactcaaccctgagctaccactaccctgatcagtcagcagccatcaacctctaggcaagaccctccaccagcagaaagattacaatttgctgaaggctcagatgtttgttagcattttttagcaataaagtatttttaattatgatatgcacattgttttgcaaacatgtgtttgcacacttaatagactataggtagtgtaaacataacttttatatgcactgaaaaaccagaatttcgtgtgacttgctttactgtggtggcctggaaccaaactcagtatctccaaggtgtgcctgtattggttttcagcactttgactataatgtgtgtaggtgtggttttctttgcatctatcctacctgaagagtgttggatctcttatatcttgagtttgaaatttttaattaaatttagaaatttttcagccattgtttatctggatatatttttctgaaccattatctcgccctttttctaggactctaattgcagatatgcagaatggcttgatttagcttcacaggtcattctggctcaattttttttttaacttctgctgtctgtgctttagttgaatatctcttggtgcgtcttcaagttccttaatccttttctcttaaatattcaatctgcttttaatcctcttgaatgaattgtttgcctttttcagttctggaatttccatttagttcttcttttgagtctttatatctccacagaattcttcattttttcactcattatatatatcttttcttttatttaatacattttaatatttaaaagtcattgtttgctaatcacaccatctataattgtttctgtgactttctctataatgtcttcctatccaaatagaccaaaaactttacaacacagagattatgattggctgtttctcttctttatccaagagtaaatacctaatatgtatttgttgagtgaaggaatgaatcaaagaacagtcctctaagcaccacaagctttacaagtgcaatgccataaaaaatgctcataaagacacttgtaacaaatttttgaaccaagccccaaatataaaaatggttccagtggcatatatatttttcaatattaaagttatagtaatggaagtcattttactcaaatgctttttaatttttcatagttgatactaacataaggatttttttgtctggtagtgccatagatggagcagagtgaagcaagataaagcctgttgatttttcaattcttgtagttttcctaagcttgcaggtgagtagtcatcatttttatgattctctttttcaaaaccatccacaatattttctgtggttcctgtgtgattcatctatagtaggttgttcatgtaaagaccacataactgcaattggctattctctctctctctctctcaaaatttaactggtaaagcagcataaagcaacacaaatctcagtgagacgccattaagtatacctgatcttggaagctactttctttaaatacatttagaatttaacctgactgtaggtttcagagtccatatcaaatcccatgtggaagtcagcccctttgaaaaattctcataagtttaccagtggacaagaataacgtagttaaaaaacaaaagtgtgccaagtagagtcagatgacaaatctccagtatccagtatatttttaaaaatatgttactctatttgaaccaaaggtatggagctgggaaattccaacaataaaatgactatggcagttcctctgatctgaaggggatacgttcccagagccccagtggatgcccaaaaccacagataacagtgaactctactgatgctatgtattttttcctatatatacatacctatgataaaatttagtttataaattaggcacagtaaatattagaaaaagtaactaatagttaaatgaaacaattttaacaatatattgtaataaaagttatgtgaatgtggtctgtctctctcagaagatatcctattgtgctgaaccacaggtaactgaaggtacagaaagtaaaatagtgggtgggggtaactatcccatgtatatcctggcacacatagccctggctacacatagcaatgtctcaaggatcaagtccctaactccttttattttatactccagactttctgcctttctaagaatcttgaaaaataagagactgcattttgtttttgtttcattaaaggcgggtgtagtgaatgtttatagaatatcaataatgtagtttgtagctttgcataattaaaggcaccccttatgttaataaaattacatgaaaagaggcagtacaaaacaaagcattaatatgttcacacatttggtcttatttcaggcaagcttaattacaaagacatgggtgtctgctacacctataaaaatattttttgtcacttagagctatcaagccttatacccatttatgatattagtgaaaaagagcaaacatcatcataatggcccaccagtgaatacttgcagccatggctgtgtagactatgaatctgcaaatagaagcatatgtaaatgaacaaagactttccacacacacgcaaaagaagataatatgttattctctgtgtctatgttaaagtgccaaccaacagaaaaagctgaggagattcatttctcacgtgcatcattagtgtcagatgcagcaattgtgataatgcaaaatccacagttgctttaagtcagaaaacccagactgagttctagcttctcccgttcctcacttcatgccattgggcaagacacttaacttctctgagccccaaatttttaatttttgaaggttaaatcaataatttataagtcacgcacttggtatgaggactatacaaaagttacatagtgatttatatttatgttaataatttttaatatctagtgtctgacacatattatgcaggtaacaaatatttattccacttcctcctcttgtctgacagaattgtgaagatcaagtgaggtagtatatatgaatgaactttatatgaaagagataaaatatagctattttccttgttgttgcaaagaatatgagcacactaagtttctacctaggaacaaacaattgaactgtgattcattttaagtttacaagatagttcagggctggattttttttttttttttttttttttttgagacggagtctcgctctgtcgcagggctggattttagatagagagcagcaaagctcacaatgtttttggataaaatttaccctgagcatccattcagagagtgaactaactctgagacaatcacaggcaattgggacagcttttgggactataatatgcatatgagtcccgagcatgctgttccttacatatgcagaataaacaattgcctacataagatttgaagcaggtactatgcaatccctatatttccataaatagccaggttccaaagtgccttatattccatcaagggagattcattttaccatcattggtataggggttacggaaaattacagaaattaaaagcactttgtaagccattattcacttaacaaactagactgattatcaccttcatcactgtcaccattgccatcaattggttctattcccaacaaattacgtctggttgagaaaataggtaaaattcattcacacaaaaatgttaggtaaaggacaggagagatcaagatcactatttgccttgctttggtaaaatactgggtaaaaagggtgacctaaaatatggaaggagtcagaagaaaaaaaaaattggtaccaattgtaacatttgttaataatctaccaaataatgggctaagctcattacatgaattatcttatttaaggaattagttaagggatgatttagcacatttacaaatactttataagagaatttggagatactaatgctctccggatataaagcttggaatttcattagccatcataagcttataaagtaagctaccctgagaacaatgctggcaccccaagcagggcagagtcaagagaatcacagatacatagtgtcactgccatgattaagggacatgtgaagctcaccatattctcttattccccattaatgtgcacttcgtgaaaagtaaactataaaatgtaaataaatagcatagggcctgcctggatgctatatttggcttgctcgacccctccaaatgtcatatggaaattttatccccagtattggaggtgggcctaactagaattgtttgagttatggaggcaaatccctcatgaatgtcttcatcttactttattagttaccaagaaagctggttgttaaaaagagcccagcacctcccccacccttttcccctctctcttgcgtcctctctcccttgccatgtgatctcagtacacaccagttcctcttagccttttgctgtgagtataagcagtctgaagccctcacccaaagcagatgctggcatcatgcttcttgtacagtctacagaactgtgagctaaataaacctttctactttataaattacccagcttcaggtagtcctttatagcaacactaaatggactgagacactggcctaatgcctgtaaggttttgcctatgtataaccttattatgagaatatcacctattccttgtgtatacccacattgttgaaatccacccattccaaagtatgtccttcaaagagtggcacaatttatatctagaaaaaaattaacataagaaataagtacttaagaaaattgtcttccttaaattataatctatttaaagagtgtgggatgtgtgtcaacttgactgggctacaggtgcacagacatttagtcaaacattattctgatcgtgtctgcgtggatgtttccgattagattaaatttaaatcaatagatgagtaaagaagattgccctctccagtgtgggtgaacctcatccaatcaattgaagaccataatcaaacaataaggctgagtaagagggaactttcttgcctgagtggtttaagctgggacattggtcttttcttgccttcagactcaaaatgaaacatctgctctttatggcttgagcctgttggctttttgactagaacttacaccatcgggtctcctgtttcttaggccttcagatttagagtggaactataccatcatctctcctgtgtctccagctttccatgtgaccatagaacctctcagactccataatcatgtgagccaattctctataataaattatatatataaatgatatgtatattatattatatatctattactatatataattttatatgtaagtatatattagctacatattttaaattatgtgtataatgagatatttatttatttatttatttatacatatcctgttagttctgtttctctggagaactctaacacaaggagagaatcttggtttttagttaggtgaagcagcttgattagactaacccccctactgataacaactataaactaaggaaataataaagaaaacaatcatggaagtcattggagaatgaccaaaagcagaacctagagagggtatcacccttatcaagaaggaaacacactaggaggagatccacaagcaatacttatattttccctcaggttgctactagtcttgtggctcacgaagggatagagctcaaacaaaaagaagaaactctattgatctgggaagtatttttcttttttcttttcctttttctttctttctttctttctttctttctttctttttttttttttagttcagcgccactagaacagtgggaaactagtaagggaacacctcagaaagatgcagctacagaagcagcaactgcaaatatgcacacaaattcccctcaaatcctgaattgaccctgaattgcacatagataaggcaaggtttcagggacactagcagaaggatacaggtggaaggtttaaagaactttccgagatttcagtagctgcccattactggacagacagagattggagttggagtcttgtcaagttagaaaggcttagtaaataccttgcattttcacttgacaccaaactctatatccagtggcaaaagcaaaacagaagtagacttatcccaacaaaggcccaaaccaagtttccacccataattaaactgctcactagaataaaacaaatcatccttcataaaagactttttaaaatgaaaagataaaaaatgggcaaagagatgggtacatttttggaaaaggtacaaactgtaaatgaactacatggaaatcctagacttgaaaaagaagcatgtgaaataagaaatttattggataagtttaccaacatatttagcacaacaaaagaaaggatatatgaggctgaatcacagaaagataaaaagaattaagacaaatgagcaaaccctcaatgacttgtggtataaaatctaaaatacatgtaatcagagtcccagaaatagaagataaagaaaaagggtaaaaagtcactttttcaatacatagatacaggaagatcagagcaccccaagcaagaaaaacatttaaaaatacaaaagaaaacaaaagaataaaaataggcaatttggaaccaatcttacataaaccaaagaaaagaaaagaatatcttaaaattggttgagggagggggaactattgcttactggggaacaacagtaagaatgacagcattaggagatcgaagataagaaaacaatttttaaagtgttataagaaaaaaaaatgttagcctaagatgatataaactgggaaattgtccttaagagatgaaagccaaataaatacatttgcagaaaaatcaaaatcttgagaatgtgttgcatatggatttgcgctccaagaaatgctacaggttcctcaagttgaatggaaatgataccagataaaactacagttgtccctcaatatccatgggaaattgtctccaggaccccctgggataccacaattcacagatgcttaattcctttatataacaagtgtattattgcatataacctacacattttctcttgtatacctcaaatcatctctaaattactaataatacctaatacaatgtaaatgctgtctaaatagttgttacactgtattgattaagggataatgacaagaaaaaaagtctatacagttcagaacagacccaacaatttttttcaaatattttccatctgcatgtatatgaatccacagatgcagaattcacagatgagaagggccaactgtacagatctctgagaagaaatttaataacgaatatgtgggtagtaataaatatttttttcttaaattctttggaagttaactcacagtttaaataaaaacagtaatttttttttggtgaggcttataatagatccaaagtaaaattcattataactatagcataatagacaggaagtgtgtaaatataataaattacaatgttgcaaggttcttactctttccacatattgcaagattcttactttttccacaaggtagtaaaatattaatccataggagtctgttgtgtgtgtgcattgtaatatctagagtaatctgtcgacaaaataatgtaatgaagggactctaaaaatcaaataggacaataaaatgaatcctaaacaatactctgctcaaaataagtcagtaaaaggaagaacaaagatcagagggtgcacatacataaaacttagcaagatagtgagtgataagctcaatcacatcaataagtgtattaaatgtaatgaataaaacactctaattatatttgtcaataaatcaatgtaaaaataatttagtttgcccagatcaagataatagattaaatacagacatttaatttctgctcatttcctgccttatataagcctactaaaattagagtaaaagtgttttatttttctttttgccccaaatggttttttgggtgttaatccctaaatcaaagagaatatgaaaggacacaatggcattaaagatatatatattttggaaagtgagaaaaaagaaagaagaataaattatcaatggcataagtcaagaagatgtcatagaactgaaggacatagacatgagctcccagatgtaaacagctcaccaagcaactagtacaatggttgtgaattaacccacatcattgtgaaatttcagagtgctgaaggcaaatagaaggtgctactggcttgcagagaggcaaaacaaaaacaaaaaacattttttatacaaaggtatggaggctagttgatggaagtttttttaagctagaagacagtggagcaagtcttcaaaattctaagcaaaaatgatttctaatctagagttccatactaatgcctaataattttacttctaatgtaacatttttaataagctactgaaaacagaatccaataatttaaacaacaacaaaaagtaaccaagaaggagaaatacaagaaatctaagaaatagggaatccattacaggatggaagttaaaggaatccacaggatgacggtagaggaaaagccaactcatattcatttgctacgtagcaggtcagaaatctcccaaagagatttttctttttttcaagaaaataatgggtagaatatttaataggatttaatctagtaagaataaaattgtgtacaccagttaaggaaggtttgggtttgaaataccaagagaacataaaatactaagacaaaaaaagtaatccatcagcaagggcaaatgaccagaccaagcatatgccatgtctgctaaaacggcaacaagccagtcttaacaatgaagctagttcgtgagggaaaatcatgaaaattatggagacaggagtggtagtcgggtttagtttacttattgttcatcacattcttggagaacacacagaaatctaatggagctggaagtcagattctgtgtgagagactttaaaattacataattagggaaaaatcatgcaatttaaaggatactgactcttactggtataagagactagcatccaacagcaacacaatatggaaaccaaccctattttataagcaacctatttatgtatggaaatcacctacctttctaaaatgttataggcatcctctgaggtggcccactaatgataggcacttcctgatgttcatattttttgtttaatctcccattctttgagtataggctggacttattgactcacttctaaggaatggaatgctgtggaatatcactttctaaactaggttataaaaagactgtggcttccatctttggttctccctctccctctgtcttgttcactccaggggaaaccaggttccatgtcatggggcagccctgtagatcagcccacatagttgaacttggaaacagattttctaaatcttaccaagagtcacatgtgtgaacttgtaagtgactctcccccaagtcaagttttgaaattactggactccttgatcacatcctgataagggagtaaatcatcaccctccagctcaactactcctccttatgactcactgtaactgtgaagtaataaatctttttgctttcagttgctatgtcctggggaaatttgttatgcagcaatagacagctaatacacctagtgggatcagaaagctgggcttcaggccttgtagttacagcttatatggtaaggtgaatggctgacccaatttaccccctcagctttctaccaaaattgattgccttaagcactcagttatgaccagttttcatagaattttatagaaggccaccttgcaaagaagtcttagacaaactaatctttgattctcagtttaaaccttctctgtgatcacaaaaggggacttcatagatcagaaagatctatagacatcagacgtatagatcagattagaatacactaacatgtcagcaacttgtagttgcaatgctagtcacaaatatgattatgataaactctggaggatggataacagaatacataggagaagaaacatttcaaaaaatacacttgaagctctcctctatgtcagactgtgggagctctgacctgactagagaaaaggtcccaacgttcttacttgggtgccttatacaaacatccttcctgttactctatttgggacaatgattctcccacttttccacttgttgatagcctctataaaacataatgctggtaaggatgtaacacttcttcattggccaatattgaaaagccattccattgtataaaactacccttgcaaaagaatcttagctagcccacggtgactccaagtcccagactatctaaatggccatttgacttagcttgatgtaaaaaaaatctatattatagtcagattaatcacccctacatggggataaaatataactgaggttgtggattattttgactttcactatcagtgccctttccttcagtaagataacttgtctgaaccacaggggccagaaaacaagccctggaaaactcgcagtggccagataatcaatttaaggcagcatattagagtctcctttggcagacaggggagcatcatgtatctacatagaaagaaccacatggaaggggcacattgtcccatccagagagtgccatttatagtcctagggtccagtcactggctgctctcatagatgttacattttagtgggtaagacagacaataaagcaaagaaccatttcaaagagctgtgagtgctatgaagaaaaaaacgggttatgggtagagagcaactgaagagggtatgtgggagatattaatagggttgccaagacaggtccctctaaaggaatgatatttgagctcagagctagtcatacaaaatcttggagaaaatattccagatggcaagcaagcaagttcacagtcaggaagaagtttggtatgtccctgaaacaggaagctactatgacttgaaagtaagtgggagagtgtgtgaaagagttccaagggcaaagggccatgtagagcctcgaatgtttgggtaaaatttttaattttaattttgcgtatgagctgaaaccactgggaaatttttagcagaaaaggaataggatctcattcaagtttttaaaaagatgtctttctgtcttggttgataattgattccagagcatgaagcaaaaaagtccaggctgaggtgggcagatcacaaggtcaggagatagagaccatcctggctaacacagtgaaaccccgtctctactaaaaataaaaaaaatattagctgggcgtggcagcgggcacctgtaatcccagctactggggaggctgaggcaggagaatggcgtgaacccgggaggtggagcttgcagtgagccgagattgcaccactgcactccagcctgggcaacagagcaagactccgtctcaaaaaaaaaaaagtccaatgagtagaccattgtggtagttcaaaccagagacgatggtggcttggaataaataagaacagtggcatgacaatctgtagactgggttcccaaatattttgggggaaaaactttaataacctgctgatagactggaaatgaggagagagagaaagcgaaaaatcgaaaaatgattctcaaagatttactttgagaaggagggagctggtagtagagaaggtgaaataaagcttactgtttttcatctatgcaatactgagatgctattagtcatctaaatgaagatgtcaagatgaggggtcagttgaggtgagaaaccgaataaaaattcagggcttgtgataaaaattagagacttaccagtgtatcagtggtgtgtaaaattgtagaagtagatgagattaataaagaaaaaaattcgttacaagaatcattggatagatttagggatcatggcagatgggaggcaggactagattgctccagacacagcagtatgcggaggctcgcattgtgaattttagcttcagatcgactgcaagaaaaaaccagaaatcccaagaggacccacagaccctctgaaggaagcggactactcctgcaggacccaggagacaccctaaatactgtgagtgccccaactgcagaagtgggaaagggagagcctcctctcccaaacacacacccccactggagaagctgaaggtctgtttgcgggagaagtttccgactttacttggagctgagtcaggttagagagccaagctgaacaaaatacaggggtagaggaagcagcagaaaagctctgggagcttgctgggtccccacgcagcctattgctgcctggcaccatagggatccatcaggagggtggccagagaagccgagggtaaaactccacaggcagaaggaattctctagctgacctttgtaacaatttgaacagagtgagaagcctcctggccagaacttgggagagggtgtgaatccggcttacagacttcacaggtggaggaagaactaaagcccttttctttcacaactgggaggtggaaagcctcaggcaagttttcaagcctgtctcaccctccacctggaaacagacttggggctgttgcagggggcatggtgggagtgagacaagcccctcgatttgcatgggagctgggtgaggcctgtgactgccagctttcccccacttccctgacaacctgcatgactcagcagaggcatccataatcttactaggtacacaagtccaatgacctgggaatctcatccccagcagccaaagcaagacccgcgcaagaagagtctgagctcagaaacacctagccccatccccacctgatggtcctcccctccccaccctggtagcagaagacaaagggcatataatcttgggagttctagggccctgcccaccactggtccttccccacactactacagctgatgctttctggaaagcaccacctcctggcaggaggccaagcagcacaaatatagagcattataccaccaaagctaaggaccctcatgaagtccattgcaccctacaccatctccactggaataggtgctggtattcacggctgagagactcatagacagttaacatcacaggactctgcctggagccaggtagacttgctgggtggcgagacccaaaagagagacaacaatcactgcagttcggctcacaggaagccacatccataggaaaagggggagagtactgcatcaagggaacaccccgtgagacaaaaaatatctgaacaacagccttgagccttagagtttccctctcacagaacctacccaaatgagaaggaactggaaaaccaaccctggtaatatgataaaacaaggctggtcaacaccccccacccccaaaatcacactaattcaccagcaatggatccaaatcaagaagaaatccctgatttacctgaaaaagaattcaggaggttagttattaagcaatcagggagggaccagagaaaggcaaagcccgaagcaaggaaacccaaaaaatgatacaagaagtgaagagagaaatattcaaggaaacagatagcttaaagaaaaaaacaataaaaaaattcaggaaactttggacacacttttagaaatgtgaaatgctctggtaagtctcagcaatataattgaacaagtagaagaaagaaattcagagctcgaagacaaggtctttgaattaacccaacccaacaaagacaaagagaaaagaataagaaaatatgaacaaagcctccaagaagtctgtgattatgttaaatgactaaacctgaaaataatcgttgtccctgagaaagaagacaattctaaaaccttggaaaacatatttgggggaataatcaacaaaaacttccccagtcttgctagagaactagacatgcaaatatgagaagcacaaagaacacctgggaaattcatcacaaaaagatcttcacctaggtatattgtcatcaggttatctaaagttaagacaaaggaaagaatcttaagagctgtgagacagaagcaccaggtaacctataaaggaaaacctatcagattaacacagatttctcagcagaaactctacaagctagaaaggattggggccttatcttcaaccttctcaaacaaaacaatttacagccaagaattttgtatccagtgaaactaagcatcatatatgaaggaaagatagtcattttaagacaaacaaatgctgagagaatttgccactgccaagccaccactacaagaactttaaaaggaactctaaatcttgaaacaaatcctggaaacacatcaaatcagaacctctttaaagcataaatcacacaggacctataaagccaaaatacaagttaaaaagcaaaaccaaaaccaaaaaaaaaattaaaaaaaaagtacacaggcaacaaagagcatgatgaatgcaatggtacctcacatttcaatactatcattgaatgtaaatggcctaaatgatccacttgaaagattcagaaccgcataatggataagaactcaccaaccaactatctggtaccttcaggagactcacctaacacataaggactcacataaacttcaagtaaaggggtgggaaaaaggcatttcatgcaaatggacaccaaaagtgactggggtggctattcttgtatcagacaaaacaaactttaaagcaaaaaatcccagcactttgggaggccgaggcgggtggaccatgaggtcaggagattgagaccatcctggctaacacggtgaaaccccgtctctactaaaaatacaaaaaaaaaaaaaattagccgggcatggtgacgggagcctgtagtcccagctgctcaggaggctgaggcaggagaatggcgtgaacccgggaggcggagcttgcagtgagccgagatcacgccactgcactccagcctgggcaacagagagagactccgtcaaaaaaaaaaaaaagcaacagcagttaaaagtgacaaaggaggacattatataatgctaaaagtccttatccaacaggaaaatatcacaatcctaagcatatatggacctaacactggagttcccaaatttgtaaaacagttactaatagacctaagaaatgagatagacagcaacacaataattgtgggggacttcggtattccactgagagcactagacaggtcatcaagacagaaagtcaacaaagaaacaatggatttaaattataccttgaaacaaatgggcttaacaaatatatacagaacatttcatccaacaaccgcagaatacacattctgttcaacagcacatggaactttctccaagatagaccatatgataagccataaaacaagcctcaatatatttaagaaaattgaaattatatcaagcactctctcagaccacagttgaacaaaactggaaatcaactccaaaaggaaccttcacaaccatgtaaatacatggaaattaaataacctgctcttgaatgagtattgggccaaaaacaaaatcaacatggaaattaaaaattatttgaactgaatgacaataatgacacaacctatgaaaacctctgggatacagctaaggtggtgctaagaggaaaattcatagcgctaaatgcctatatccagaagtctgaaagaatacaaacaaacagacaacctaaggccacacctcaaataactcgagaaacaagaacaaaacaaactcaaacccagcagaaaaaaggaaataaccaagatcagagcagagctaaatgaaattaaaataaaaaaatacaaaagataaatggaaaaaaagctggttatttgaaaagataaataaaattgatagaccattagcaagattaaccaagaaaagaagaaagaaaatccaaataaccgcactaagaaacaaaacagaagacattacatctgacaccactgaaatacaaaagatcattcaaggctactatgaacacctttaggcccataaactagaaagtctaaaagagatggataaattcctggaaaaatacaatgctccttgcttaaatcaggaagaattagataccctgaacagaccaacaaaaagcagtgagattgaaattgtaatttaaaaattaccaacaaaaaaaagtccaggaccagatggattcacagcagaattctaccagacattcaaagaagaattggtaccaatcgttttgacactatgccacaagagagagaaagaaggaaccctccctaattcattctatgaagccagcatcaccctaatactaaaaccaggaaaggacacaatcaaaaaagaaaactacagacagatatcgttgatgaacatagatgctaaaatccttaacaaaatactagccaaccaaatccaacaacatatcaagaagataattcaccatgatcaagtgggtttcatacaaggggtgcagagatggtttaacatacacaagtcaatacatgtgatacaccacataaacataatttttaaaaaaaatcacatgatcatctcaatagatgcagaaaaaacattcaacaaaatccagcatcctttatgattaaaaccctcagcaaaatcgacatacaagggacataccttaatgtaataaaggccatctattacaaatccacagccaacataatactgaatgggggaaacctgaaagcattccctctaagaatgggaacaagacaaggatgctcactctcaccactcctcttcaaaatagtactggaagtcctagccagagcaattacacaagagaaagaaataaaggacatccaaatcggtaaagaggaagtcaaactgtcactattggtgacgatatgatcgtttaccttgaaaaccctaagaactcctccaaaaagctcctagaactgataaaagaattcagcaatgtttctggatataagattaatgtacacaaatcagtagctcttctataccccaacagtgaccaagcatagaataaaatcaagaactcaactccttttacaatagctgcaaaaacaaacaaacaaacaaacaaacaaaaaaaacttaagaatataccaaacaaaggagttgaaagactgctgcaagggaaactacaaaacactgctgaaagaaatcatagatgacacaaacaaatggaaacgcatgccatgcccatgaatgggtagaatcaatattgtgaaaatgaccatactgccaaaagcaatctacaaattcaatgcaatccccatcaagataccaccatcattcttcacagagttagaaaaatcaattcaaaaattcatatggaaccaaaaaaaaaaaaagagcctgcatagccaaagcaagactaagcaaaaagaacaaatctagaggcatcacactgcctgatttcaaactatactataaagccatagtcaccaaaacagtgtggtactgatataaaaatgggcacatagaccaatgtaacagaatagagaacccagaaataaacccaaatacttagagccaactgatcttcaacaaagcaaacaaaaaataaagtggggaaaggacatccttttcaataaatggtgctgggatagttggctagccgcgtgtgggagaacgaaactggatcctcatctctcaccttatacaaatatcaactcaagatggattgaagacttaaacctaagacctgaaactataaaaattctagaagataacattagaaaaacccttctagacattgttttaggcaaggatttcgtgcccaagaacccaaaagcaaatgcaataaaaacaaagataaatagctgggacaaaactaaaagagtttttgcatggcaaaaaggaacagtcagcagagtaaacagacaacccacaaagtgggagaaaatcttcacaatctatacatctgacaaaggactaatatccagaatctacaacaaactcaaaaaacaaacaatcccatcaaaaagtgggctaagaacatgaatagaaaattctcaaaaaaagacatgcaaatggccaacaaacatatgaaaaaatgctcaacatcactaatgatcagggaaatgcaaatcaaaaccacagtgtgataccaccttactcctgcaagaatggccataatcaaaaaatcaaaaaacagtatatgttggtgtggatgaggtgatcagggaacacttctacactgctggtgggaatgcaaactagaacagccactatggaaaacagtgtggagattccttaaagaactaaaagtagaactaccatttgatccagcaattccactactgcatatctacccagaggaaaagaagtcattatttgaaaaagatacttgcacatgcatgtttatagcagcacaatttataattgcaaaattgtagaaccaacccaaatgcccatgaatcaatgaatggatgatgaaactgtggtatatatatacatgatggaatactactcagctataaaaaggaatgaattaacagcatttacagtgacctggatgagacaggagactattattttaagtgaagtaactcaggaatggaaaaccaaacattgtatattctcactgatatgtggaagataagctatgaggaagcaaaggcataagaatgatataatggactttggggacttggggggaagagtgggaggggggaaagtgataaaagacaacaaatatggtgcagtgtatacagctcaggtgatggatgcatcaaaatctcacaaagcaccactaaagaatttactcatgtaaccaaataccacctgtaccccaataaattatggaaaaataaaacaataaaaatttctaaaaaattaaagataaaaaaatgagatgatttctttttttaaagaatccttggacatttcagttaaggtaaaacaattcctggggttttcacatctgagtcattgagtcgtcaaagcaaaaagaggcctcctcagtaaacaatgtattaatatttaggtaactctgtctttgagaacctaaagtttccaaactcttcatttatgtaaacttactgagtgacaccaagtcagtgtagtttcctttatgtaggtgactagtattttctttaatattgtaattatcagaagagacaaaaggaattgctctgttaaatctgtatctaaagatggtggtatggaggcatggctttttaacataatggcttagtcttgttgattcattttagaaaagagattaccataaaatatgtggtaaattggagattctcaataacgactactttaaatattttctaaataagtattcacacgactcttttccattgaagctgttagtacctgttcattagtacctgtataaatgttctaacacaagcagctgtacaaccaatgctaaatgaaataaaaactgacacatttcagagaagtcttgtgttcttctcacctacttttgaagattgaagattattctgttttcttcttattatatcaaaagaggtatatttcctttcttttttctttctttccttttttttttttttttttttttgcagagaaaactccaagtattttttgcaaggaaaagttgatgatactgatgatgatggtgatggtgatggtggtactgattagagtgctgatggtagtagtcctggtgagtgttggtgatcatagctaatcatcactgagatactactgtatttcaagtgctgagataggagcttaaactgtgttctcacaacacaacaaaatgcaaattatttactttttttgcagattaacaaaatgaagatgaaacacagtaaattactttttcaaattacttgactggtaaggctaggatccacatcttggtctatttaacgccaaagcatttattcccttacactttttcatcctgtgcatcaatctattagagttcttgtctttatgttagtcatactcttatgtttaaaagcaaatgaagataatttctaagtcaaatgtgtgtgtacgtgtgtttacatttctaaggatactgagacaattgctatacaaaatccaaaggaaatatggcttcacaaattgtagtagatgtcccaactgtattccctgagatctcaccattgtaaggaactactgggcttccaactgcctgaaggtaccacaacatcagatcagaaagtgttaaaatatattctaccccccaccccatgcccagtatctctcaaccaatgttagatttagtatgcaaatccttagctcctttgcccctggtctgagctaactcttaggcacttgtcatatatgaccccagagttcccacttgaaattgccatttaccttgccgtactggtaactggcttgaaaatatactctttattttgtgccttttcttttctgcctcagttctccactctcctaacaatgcttcctgggatctccggccaagtaaaccagtacttttcaaaccctagcctcagggtctacttctaaaagaactcaaattaatctttctcatgtatgtccatgtttttattctggcttgaaaattttgggttacctattgagattgtacagcaaagaaaatatttgagcagattgcaggcagtattatatccaccatggtactctcccttcatttttaatgaaatagagtttcaactatgttcactgcattctcaatccctagttactagagctgagacagctttgcctttaaactaaaggttatttggatttttgggccacgaacagtgcaatgcttggaacttcctatatttatctggtgcaaagtcctttatgtgtggtaaacaagagtctagggctctatggactctcacttttcatcatagttgttatagcactcctgacctcagcctagaattgtgagaatacagggctgctcccaaacaagtgaggctgagttattttgtttacttgacacttttgatagaagagagaggtttcattctaaaggactcattcctgtagaaatttgatttacagacataccccagatatattgtaagttcaggtccagaccaccacaataaagtgaatatcacaataaagtgactgacacaaaatttttggtttcccaatgcatataaaagttatttttacaccacgctgtagtctactaggtatacaatgacattacatataaaaaatacatatcttaatttaaaaatcctttattactaagaaatgctaacaatcatctgagccttcagctaattataatctttttgctggtggagggtctttcttcaatgttgatggctcctgggtaatctgggtgatagatactcaaggttgggtggttgtggcaatttctgaaaataaggcaacagtgaagcttgtcacattaattgacccttcctttcatgaagattctctgtgcatgtgatactgttcaatagcattttatcagcactaaaacttctttcaaaattggaggcaattttctcaaaacctgccactgctttaccaactgagtttatgtaatagtctaaattctttgttgtcacttcaacaacatacacagcattttcaccaggagcagattccatctcaagaaacactttcattgctcatccataagaagcaacttgtcatccagtcaagttttatcatgagattgcagcaattcagtcatttcttccagctccacttctaattctagttctcttgctgtttccaccacaactacagtgacgtcctccactaagtcattcatagagattgaaattaacttcttccaaattctggttaatgttgatattttgacctctgcccatgagtcttaaatgttcttaatggcatcaagaatcataaatttttttccagaatattttcaattggctttgcccaggtacattagaggaatcactaactatgacagctgtaccattgcaaagtgtatttcttaaagaataagacttgaaattcaaaattactccttgatccatgggctacagaatacatgttgtgtcagcaagcatgaaaacaacattcattttattgtacatctccatcagagcttgtggatgatgaggtgccttacctttaagaaataatatttttaaaggaattcttttttctgagtagtaggtctcaacagtgggcttaaaatattcagtaaaccatcatgtaaacagatccaggctttgctgttccatctatagagcacaggaaggtagatttggcataataataaggaccctaatatttttgggatggtaaataagcattggcttcaactttaagtcaccagctgcattagctcctaacaagagaatcagcctgtcctttgaaggatttgaaaccaggcattgactcctctctaacaatgaaagtgccagatggcatcatcttccaatagaaggctacttcgtctatattgaaaatcagttgtttagtgtagccacctccatcaatatctcagctagatcttctggataacttgcagcttctataatctgcacttgcagctttaccttgtatttttaagtaatgaagatgacttttttttcctgaaaactcatcaaccaacctctgcttgtttcaaactttttcttctatagcttcctcacttctctcagccttcattgaagattaaaggctttctctaatcatcaaccaacctctgcttgtttcaaactttttcttctatagcttcctcacttctatcagccttcattgaagattaaaggctttctctaaattagactttggcttgaggaaatgttatggatggtttgatctttctagaccactaaagcttttttccatatcggcagtaaggttattttcttacaatttgtgaataccctggagtagcacttttaattttcttttcctctgcattcataactgggctaacagtttggctcaagaggcctatctttcagcctttctgggcttttgacatacctctctcactaagcttaatcatttatatcttttgattaaaagtgaaagacgtgtaactactcctttcatttgaacacttagagaccattgtacggttattaattgtcctaatttcaatattgttgcacctcaggaaataaggaagcctaagaaggagaagagagatagggaaacagccagtgggtggagctgtcagaacacatacaacatttatcattttagttcactgtcttatgtgagcatggtttgtggcaccccaaaacaatcacaataggaacatcaaaaatcagtgaaaacagattaccataatggatataataataatgaaaaagtgaaatattgtgagagttaccaaaatgtgacaaaggggcaggaagtaagcacttgcttttggcaaagtgatactgatagacttgctggatacagtttctgcacaccttcaatttgcaaaaattgcagtatctatgaagtgtaataaagtgaagtgcaataaggtgaggtatgcctgtacacagtgtagcacttagatgtaattctgaatgattctggcttaccttcactcacatttctttattccataaaatttttaactcattttatcatttgttttataagatagctaataggatattcattaacttatttacagtagtggacaatggtttgtttatagtaagctcattttttgctgctgtataattaaacattttttttctgaatttaacttaccctgaaggcattattggagaaaatgcatctacagtatttacatttgtaactcctttttaaatttactagcacagggaaattttattctttttaacacatcttgggtttggttctttgtctctggatcaaatagagatcacaattactagactatttaatgtcccatatgaatttctcaggctccttactctctgagaattcatctgcacaatttaaccacaggaagaaataaacatttctttggatttatgagaagtaaaatattcaaacctcaactgaagaaacattcatatcatctgggtatgttcaagaaaaaaaaatgtaagccagaccatccaacaacacattaaaagagatagtcatttctctcatcttggggctggaaatttcttttccaactgacgtttccaacatgtgaaatatagctgccatcacattaaccagatatacagcactctgagctgaaagcataaattgtacacatcttgctcccagtagctgtgaaaaggaaacgtaggtgcaaggtcaacaagaacccctcctatagaagaagtctgcaaattgagaggggaatgggagatcctgctattgctgggatggtcctgttttttgtcaagctatgtcatgggaccaagaggctcaggaaatgagcaggaagattttgttctggatgaaaaggactacttcatgtagtctttgacatactttgaaagggaggatggaataagggagaaacagcatcacatttaatgcctggctttaccatttaccagctgtgcaaccatttaaacacttgagcaacaatttaaacacttgacccttggttttctcaactgtgctgtagaggataatcattacttctttaacctacccctacagagattttgtagggaatagatggcatgatgtatgggaaagcacattgtgtattgtaaaactgtaagcatgcagtaattataacgatttacttttattgaccctgtagtgcatgctagatattcttctcagggtttcatatagtacctcattaaatcctcatggcgaactttgaaaaaggtactattattattttcattgtacatttcagtaacttgaacaaggttacaggacaagtagaatatggcagagatggaatttgaactcaagcaatcaaattcaaaagactatactctaaagcaatggcactcagggagtgatccatcagtgcctgtgcacaacaaggtaagtgcagaaattgagcacaagtgtttgaaaacttatgtagctttttgatattgtctcaatgtcaatatgtgatcatttttatagtaatctgtgttaattgtcatttatgaaatattggtccacaatggattgaaaagaataagaactcatatttcatcacagatggttctaaaagcattgttctgaaacactacactataaggttgtaattgattttgttattggaatatcatgggcaacttgtaagacagacttgctaagagaattagaagctttataaataactatatctaattgaatattcttatgaatattataaagataaacaataatttattaaactaaaatcaggtttttgagatcagtactccgggtctggccaaatttctccactttctttccctctttttcctgctctgtactttagacacagtactaccagaatagtagtttttttacaaaacaaatattctataatatataaatagtattgggggagcacaggggagtttgatctctaggagaaagagacttgcactggccacaatcgcaaatatcccccaaataaaaaaggggggaaatgaacaactgttattagaaagtttgtatctaatcaatcatggaataaatgaaaaacatctttattacacctgagattttatagcaatgcttagaaatatattgaaattccatttttctccatgagacagtttctaggtctgacttgtttagaataaatgtttgattcttttactttcactgaaatcttcttatatatcaaacttatttcatttgctcaaagaattgccattttctcttctgcattttttttcattcaaatcccacctcaaaggaagaaattctgataaaataagaaattcctagagattattttaatatctattctgggttacatatgaaacccattgttcaaggcttgtggagcacttacataaaaaccagtttcagtcagaaattgatcataagcatcgttgtgcaaagaatataatatccaatttggtgagaagaacaaatgaacatataagcttgaattaaaaataaatataaaatttaaaacgtaagttacatttggaaattttggtccaagaataaatgtctccatgaaagatatagaaaggaggttgatttttttttttgaaacattgggatttatttatctttctcttctaaagatatatagtttctttttagcacaacagtcaagacagcaccttgggctctcagagatggtaaattctactctcagttgctccattaactcaatatatgaccttggaagtttctctaagtcccttggtgcctcagtttccttttctatcaaatacatatgtctgaaataactaaatcacttcacactgcctttaaggaaaaaataaaacaggaaaagagaagagaataaaatatctgagatcaaagaaagttggcatctaaatgccacatatcaattgaattgtaacatgtatgaaacttaaatgggagtaaataacagtaacaaaaatgagttgaattttaatatgtattaaacttcaatgggagtaaataacagtaacttaaatgggagtaagtaatggtaactattatagattattgtaaagtacttaacagggggctctggcacatagtaagcctcagtaaactttagattttactcttgttttcattatcattcctattatgataaaaatcaagagtcagggtagcagagtgtgagtgtagtggggaagaggatttactctaggaagtagacctcgtagaactgaaggaggagctagaggagttcaagtttggaaagggaattggaggattggagaaagggttgtcaatcagtcaatctatgaaccaaggccatcaattcatcaaaactaatattgccagacccaacaaattaaaaagtacaggatgctcagttcaattagaattttaaataaattctttttttttttttttggatgactatgtccctgcagtggaggactatgtctttgaagataaaatgccacgattaattctctaacacattcaggattgtctttactaggagataatagattattaccaatatttcactgctataattaactcttgcattatttgggacatacttatacaaaaatatttattgtttatctgaaattacaatttaaataaatgttttatattttacctgttaaccttagactatgaaaggaaagttcttagggagactcatgggaagtttatcttctctgtccttgtctcaccactgtaggtccacaacctggcatttagtggtaggcctggagctgctcttggtcaacagtgtcagaagttgggaagaagagctgcatatcaagcagaagagaatgagaagaaacaggaacccacttctgcatctgtctatagcaacatctgactataacgaccttcaaaagataatggctgttgcttcatttccaaccctccaaatctcaagcaagtatatctttgggccaactgtaacctataactctatagggaagaggtttctgagaactctgtgtcacagcttaaccatacgaagacaatacaaaccatcccgatgatgatgatggttggtaataatgaagaaaataatatgagtgttttctcaaggaaggctacttcttgatggcagttctgggagacataagagaagttttatttttacccaaatggttggtaaataaattactgtgtgacatgacagagttcaagttatatgatatagtagattcacattatgccaaaaactataagcctcccagacacagcccaggaattcattttgagagctatcataggcttctgaatgtgctaccatctatgctcttaatttaaaccttaatttgctgtgtggacgacagactactctgaaaaaaaccccaaatgcttcagtgcaggactatgtgtcgtggataaagtaacaaaattacatattcaacccattatggccatcctcttgtatgggagatgcagattgttaccaatatttaactcttataattaacttgaataaatttccttacaaaataaatatgtacacttgtaaatattccattatagtatctttcttagtgtagatatcctggagtaaaagcaaaatatttacaaaacaaggtaacaatttttaaagcaaaatatctattatcaaattgttctccagataggtattaccaattacacacccaccagcccagcagtgtgaaaatatcacatctcccacacccccatccacacccacgtggaaaattattattaaaaattaatttttaccaacttgagagggaaatggtcttattttaattttttcaggggtggattcatatgtttactagatatgtatatgtatccttctatgagatacttgttaggttatttcccatttctctgttgtggcattaatttctttttcttgttaataatgctcccgaagttttatgtcagtcttttcatttgtttatagtattttatggcaaaggattttcttaattaagtggttgtagtcaaatctgctagtttttatctttgttttcagtttgcaatgtcatgtatagacatggctatctaccaccaaaagtattttaaaaagcaatgtgtaggttttctacttttgaagaatgtgcattttctacttttgaagtatgtgcattttctaccaaagtctttggtttgtttgatatgtgcaatgaagaaaaatatctaacaataccttaagttttctcaaataatattccaattatcctaatatcctttgtgacttaaacttcctattctgacttaaaaagacttttatcataagtgctctacttaatcatagccttagcacatagtgtgagtcctagagtcagactacaaggtaattactgtcacttacaagctgtgtgaccttaagtgatttaatttaatcatcctgtgactaagttttctaatctgtaaaattggaataatgtgaggataaaattatcataaggattagcaagctgaattaacacgtgtaaagctcatagacgactgccgggcacatagtgaatactcaggaaatattactggttgttgtgtagcaagatgtacaatgaaacactggtacaatttcagattttgggttttgaggaccgggcttagagggtcaccttggagagaatcttgtagagtcccacatctaccctctgcctcaatgagatacgatcctccactttgatgagatattaccacttagagaacttgctacatgtcaatccctgctatggagaaagtagacttttaatctaatgcagtagacttgaaatcattcgaatgtgagagaagagctggagtcagaaagaggtaaaaagagggcctgagactatgccttaaattgttaatatatttaagggatagaagaaagaacaggagaactgttagagaagatagaaagaaattgtttcctggatcaaaaacagttctagactggactgtgtctcccacccctttaaattcatgtgttgaagctctagccctcaatgggactgtatttggagataagacctttaaagatgtaattaaagttaaatgaggtcataagagtagggccctaatccaataaagcctgtgttcttataagaagaggaagagacttcaaggatgcctggaaaggccatgtgaggacacagctgggcaggggccatctgcaagccaagaagagagccctcaggagaaaccacacttgctgacacctggatctttgctctccaacctccagaattgtaagaaataaatttctgttgttctagccacccagtctgtgggattttgttatggcagccctggcagactaatataggatccaagagaagagagagtttgaaaaaggagggagtgattgattgtgagaagtgctgctgaaaacataacaataaagtaagctgagaacttaagtgtctgttggatcaggaaataagaagtcattgttaattttgacaagaacattttaatggactgatagaggcagattgcagcggattgaagactaaagagcaggattcacatagaaaatatggcaatatttcaaatcatcaaaatgacaatatggctgagtaggcgttgtataatgaataaagaacttcataattaaatgcttattcgcaacttttagtctgaacatcttttgctgtaggagatcttgccaaattgattcccttcgtacttcccagtccaaatctaaattagtcactgctattacatatatgttaccttatcatttttaaattgtagtctgtatcatagttacttatacttctgcagttacttaattttctctctcacgaggcagtaagcaatgtgagaacaaggatcatatttggtttattccattatctatggttagaacatagtggacatttaatatgcattaaataaaactaaaattcattcaacaatatgtcattaaaatctttacatgtcaaatatatcattttactgactggattttatgtatacatgtaatttacaccagcctttcctactataaattatactatctggaattgtttagccagttaaggattaaattctgcataaaatttaacttttttcttttttctccagaaaaactgttttgaccctgggctttttttgcaagtagttttctaattttctaaataattttttggcctgtcatggtagctcatgcctacaatcccagcactttgtaaggcagaggtgagaggatggcttgaggccaggagtttgagaccagcctggacaacatagtgagacctaactctatatattaaaaatacaaataaaaacattagcagggcatggtggtgcacgtgagcatgagacgtcgaggctgcagtgagcagtgattgcgccactgcactccagcctgtgcaacagagtgaaactctgtctcgaaagaaaaagaaaaaaaattttcatggtaattgccttattcaagtttccagctctagttgtacatagcattctcatttttaatctgtgttaagtaattatttcatattcttaattctaactttgatggcttttttcctttaaaaaaactttattgaagtataatttacatataataaaatgcacctattaatttgtacagtttgatgagctttcacaaatgccaccaccataaacaagatatagaacacttccatcactcagagaagtacactcatgcccctttgcagacaatcacttctacctctgcccaaggcaaccactgatatactttgtcaatttagatgaagatctcatataaattgaatcatatggcacatattcagcagaacatggtgtcacaggaattcatccatgtagttgtatgtatcagtagttgatgcctttttattgctgcatagtatctttccaataaaacattttattcttttcaaagaataaaaaaattctttacaaacaattgcttatccattcacaagatgataaatatttaggttatcatcaggtgcttgagttttctattgctattgtaacaaataaacacaaacttgatgggatacaacgatacaaatttatcatcttatagctctggagataaaaagtccaaaataagtttcatggtactaaaatcaagatgtggcaggactccgtttcttctggatgtttagaggcagtgttttctttctttttccagcttctagaggttcccacattccttggctcctaggctcctttcatcttcaaagccaacacatctttctcatagcttcttatctctgacttgacaatgtctcttttttgctcataggtagccttgtgattacattgggcttacccagatccaggtcatctaggataatctctctacccaagatctttaacgtaatcacacctgcaaagtcccttttgcgaagaaaggtaatatattcatagtttctggagattaggcctttccaggcaaagaggtggaaatctttgtggggccatttttctgcctcctacacaaggtaaaggatattatgagtgaagctatggtgaacacgcatgaacaagtctcttgtgaacataggtttttatttcatttagtggtggaagtgctgagctggatggcaaatatatgtttagctttatgataaactgccaaatagttttccaaaatggttgctccatgttacatgctcactaacactatttgagatttcattgactccttatctttttcaatactcaatattgtcaaactttcaaattttagccatttagtgggtaaggagtagtgtctcaactgtggttttaatttgtattttcttgatgactaatatgttgagcatcttttcccatgataactgattacacatatatatttttgtgtgaagtatgtgttcaacatttatgcccattttcattgttttttgttgtcttgttaaattgtaagaaatgtgtgtgtgtgtgtgtgtgtgtgtaacaagtgttttttgagatatatatattttgaatattgcctcaaagtcttgggtttctctttttcttaactaaatatctttctatgagcaaaactttaaacatttggtgtaatttaatttttcatttttttctattattgttagtgagtatattgcgtaggataccatcatgatgatgattttttcctaccctcccacaatctgttttgtattttagcttttacatttagtcctgtgatccattctgagtcagtttttgtgtacggcctgaggtaagggtgaaggcccatttcttttccatagtaatacccagttgtttcagcactatttattgaaattactatatttctgttattgatatgcattggcaactctgtagaaaattaattatagtattgtacttagcattttaataatattttaaatccttttgttaagtatgtattgcttatattttctctttatatgtttcttttgactgtctttctaatacataactatttaataaacatgtcaaaatcagctggatttttcactatttttaaatcttggatttataagtcaattctataatttttctctcttgcaattatgcaagggattatgggaattgattataaacctgttatgaaaaatattagaatttaataagagagaaattgaaagataatatataaaagtctgtaattgcctatgttcaaataatcaccatcagaatacagaatattaaaaaatgtatgttgtttaaaaaacaacggaaagtggtaaaatagatataaattttacaagtattgcatcagacataatttaaaaagctataaagaagtataaatgaggattcaaataactgaaaatctatcctatgcctttgaataggaagatataattgcatcattatgtcactgttcactaaactcatatatatattcaatgcaatcctaattaacaaaccaagaggattttgttgtcatttacatgcttttcaccttgtagtttttagatttatatttgatttttgtacctgtaggaaactaaacaatttatattaaattcaccttgaaaataaatatgtagaggctaggacgttttctaataatggagaaaattagaaaaatctaataatgggggcagacagtcatagaatttaaaaatatattattaaataaaataatttttaaaaccttagcactagaaatgaatatatttataatggcaccagaaatgagttagaccaaacaataaaacagagtaaaggataaagaaagagacacacacgattggctttagtttatggtaatgatggcactgtaaattagtagggaagatagggataattctataaatcatattaaataaatgtaaagataagtcatcattctttaaaacaagataaatttttgatggaacaaagatttaaagcaagcataaaatttctagaaagaaagcactgtgcattgatttataatactgaaatgagaaagatctttctaaattagacatgaaaactaaacacctttacaaagatttgataacattgactacattaaaacaaacggacaaaaacttaccataaacaaagtcaaaaggcccacaagaaactggaaaagaattttgcaatatatgcaacagacacaaaacaaattttcaaaattttcaaaatgcatatataaaatcttgaagaaaaatctgcaagagctataaacaggcagtatagagaaaaatataatgaaatgtgcaataaatgtctgatgagatatggaaccccactcacaattatataaaataattaactcattcaacaaatttattgagtatttcttccatgttgggaaaacagccattaacaaaataaacccaaatctcagctctaatgctgcttacattctagtaagcaaataatagacaataaacaagataaatgaatacaatataatttattagatgaggactgagtgctgtggagaaaataaagcagagaaaggagaaaggaagttctaaggggagggaggagtgctgcaattttctatatgatacccaggcacgacctccaataaaggtaacaatggggtacatttcacaatttcacacctaatggaaatgtgtgtgtgtgctgcaaaatatatgttcaagaatgtttatagtatcattatttgtaacagcaacaactggaaacaaccatatctatcaagtctatcaatactagaataaataaatattttggtatattcacacaatgaaatcgcatgcaacaataaatctgaatgtgctacaattacaagagaacaatacgttggaatctcaagaacatatttgaaagtgaggaattcatatttcagagccttcactgtgtggctccatttagatcaaggttaaaactaggcaaaactaaaaataagtttagaagttaggatagcagttacctttgagtaggagagagatcgtaataattacactgtgcatgaggatgtctttagtttactaagagtgttctatttcttggcctgagtaatggtcacacaattgttttctcatgggacaattcattgagctgtgcaattgcaattgcaatttatgcacttttctttatgtctgttacatgtcagtttgaaaaaaaaataaaaagagtgatttaattttctttttctggatgcctaagattctttcattattcttgacgtttaaaaactgaaccagccatttttatcttttcattaacttttcctgctactcagtgaacactttgatctgtatacttgggcctttcacaggtcagagaagcttcttcatgttttccctcttttctttaataagaaatattacacttcattggctctcttgtctctggtcttcaatttctaccatattcgttcctattgtctttgtgtctgaatatttctgctgcactttaagagtaattaccatttgtctttcaaattatttatttgattttcagaattatcaattcacttctgaactttttactgctagtaattttctttctgaaattgctttttagtttcctaatatggtagtcattgaggctgttcacatgtttttagctttgttttgttttgttttttaggttgtagagaaggtactgttcccattgaaatcagtaacggccatgtgacctgatttgactcatgaaatgtaagtggaagatgaatgtagactttatgtgcagaggctttaagagttatgagataattgtcatactctcgttcataatctttgtacctcagtgattagcaacactcactgtcatgacttcttcatcatcctgggtcctagagtgaagtcctagagcccattatcaactcatgctaaatatgtaggataagcaagaaataagatcttcctgcttgaagccactgatattttggactttttgttactgcagcaacatcatgcctagcctgactgatacatggtatataatcattcctaatattttcctaatatttgtaatttatacaatttcatttgtttgcttactatcataattatataattatacaatagttacttatacaattttatctgtttactgtcataattattccaaaaattgtgaccagtttcttcatattaattgccatcatctcttttcttacagtgtggactttttcatagtctcaatgggatgtttatctaaaatgcatacattcctaaatgaagagtgcccttgtcttcactgtatattgtgttattgttagaactttcaaacatgctaaagaagctgataagtctaagttcacatcaacaattacattattcaacgacctgagagaagtgaagccaggttgagtgtagtcccagtagagagatgttttctgtgttctctttcttttgtgtttagtaaaggtacttcaccagaggtcaattttctgtaccaatttctgtttggctggagcagattccagctgtgtctgtgcttggtctcccacctgatgccaccacatcaaagggaagcccatattacactggaaacaaggccctgcttccctgctgagttttgtgttttgtgacgttcccaagcaaaattcgaaatcttcctgtttcaatttttgtaatgtttatcattaaaataatactctcacatgtgaataaatcaaatactaagattagcctatcctaatttctatacctcctacccccatacgtgtttaaacctgtagtcccactctccaggagaaacctctttttttttaattggtaatataggtgttaatttttgatattttaaatatctcaaataaagaaaaagaaagaaataaagtaaaattacttgttaaaaatcagttcaaattaaaattcactataatggttaaaacagctaacatgtattgaatgattatgctctaggcactgtggaaaaacctctttaacatgtccctgttacctccaacatactaaataataaacttacatctctgtaactttatttaaacactccggacaggtattgattgattgcctacaatttttttaaaaagttttgctaagtaaacctttaacccactccacttctcttctccatgcttaatagaaccatttcttgcaattcttcaatttgtcgttagattatatttaatatttcaaatattagtgtgcttacatttgcttccacattccctctaccatttcacttcccactgtctgtgtgctattcttttacatttataccagattttttttggttaatatattcatttagttctgcatcaccatctaagttcttacacaatttttccatgagttaagcaaagttgaaaaccattacaacattattacattattatgttattatgaatgtgtgcttgttatatttcctttcgtatatgaataatacaaaaactcctaagccacctagaagagaatgttaggagcaccaaggcaaagacaaattctcttatattccaacaattgcttcaaatcaattgtttatatgtaacttatttttttcctcaaatttcatattgccattcattttcttttgaatcacatgctttatcatacctccactttgtgccatcccctcaatcacagagtcccctgcatgacatcttcttttctcttcattggtctccctcccagagcccagcattctcctatggcactctaaaacgaccaccttaaagccggatggaccactgtcatcctgagattcccctgtattgctctgcttctttgtccttgtgtttttgtatttcttggtcttctccttcattttgctagagtacaccctcagatttttacatttaccaaaatgtaaagagattcgggaggtgtggctgcttgtttcatgacgtgggacctagttatcttctcctcaacatcctttctccttttcttactaaggaacagaatttgattttttttttcttgggctgcaaagtgcccaaataaagatgcaaccttgcagctaggtatgttcaataatttaaggaggcattgttgggtgcaatttcagggaacacttctttgatgggttaaaatacctggtaagcgctccatagacaagcatgcacctacttctaactggaacgcagatgtgataagaggaactccaacagccatttgaaacatgaggtaatcttgtgaacagaagccatgcactaaggataacaaagagaggagccaggcactaagaagtctgggaagctgatgacatcataaaactgctatactagccctgttacactatattgtacttaaaacatagctgccacttacttaaaaatatattttacaagggaaagagaaaaatttatatgcaatttaagtaacttatttctgatctcagttgctagctactgaatgcaattacatattgaaaatggtgataaaatttctgggctcttaaacatctaaaaatacctcaattctgccctcatgctaactatttttgtgattacagatttcaaggttgaaaattactttccctctatgctgtagccatttctctgttctcttctagcattaattgttgctgtcgagaatctgatgcaagtttgattttcatttctttgtgggaaattgttttctcctctttaaaaagtttggaatctttacgattttcttgatgttttaaaactttacaagaatgtatccagatgtgggtttcgttttcatttccattctttgtacaaggcactcagtaatatatgacctaaagatttatgttctgtaactcaaagaaagtgtctcctattatttcttggataatgttcgcccttccattttctttgttctgtatgtctacttgtcagttactggacctctgcatttgtttattaggttccatcctttcctttatgtttttggttctacttttatttctttacattctggaagatttcctgtatatttgaagcagctttcttgactttttaaaattttagcaattctatttttaatgtctaacatcccattaaatgttagtaattctatttttaatgtctaacatcccattcttacattatagtagttacttttcatagcatcctatcataattttatggaacacaatatcttctcaaatatctgtgtgaatattaattaaaggtattatattttggtgtttattgacattaaaatattttctactccttgtttactctgggaaaacttttaaaaatctttgttcttaaatttttatatgtgtcttataatctttgatgatttttacacgaataggactaggtaaccacgtgggtattttctgcatctgtaaggagctaattttctcactatgtctcaccttgtttctccctgagcagaaggtccagccaggagggtgggaagtgtgagaatggtatagtgcacgcagacattgggtccccaaattacagaatgaggagggtcaccaacaccacacttaaaagacttgacttttctggatggctactttaattttggtatggaagagatttgactcgtggtaaataccagactgtcttcactccacaacacggatatgggagggagaaaagggtgccaataggagtagttattttgttgctctcttctatcatactcactaactatggggcagagtctctctgggattcactgcatcagttggtttccctcttctctgcagccatctttgtacaattgaccattcctttcctgtctttcaaaaatgtattgaaaaatctcatccatcaaaatttactacccaatcagttttcttcttttcttctctattatatatttaatccttttgtttttcattcttttatttttgtgaacagaagtacatcatgttgccctagattctatattcaaaggagctgattcatgccagtaaaacagaatccaagtggtatgttccctgagttctttctgtatctccagccctctcttttggtcaataagctttcattctatgtgacacagactcaacaaatagttattgatttacttcattaaaatattcagagttagacaaagttttcggcatgcctctaccccagggtttaatgttgtcagtctgtctgtctccccatctcttgaatcagtattcttttttgcctttactctcatgatgccactagcagctccaggcttacatcaatgcaggattaagtctagaagaagagttccccagaatacaagcaaatttgccattcttagtttatttgcattcctgttacagtctctgtggtgagaggattataatgttctctgcagtataaaggaactgcatctctaaaccatttctatcagccaaagggattcaatgctctgagtgcccactctaataccaggggtggtgttgctgacattgctagtttcattgaaaattcattttccctttcttcccttataaatataactcttggattttagttggcttcatggcttcatttcccatccttccttagagctagatgtatgctcatgggtgtattttgatccatagcatgtaagaagtgtatatgccatttcagggaggatggcagtgcaacaaaagtgatggaatttagatctggaataccaaagggcttattgccagtcctggtcactcatctatcttaatttacatgaaaaataaatttcaatctgtttcagctgtcttgggttttctgtaattcacagctaattatttttttcttttttctttttctttctttcttttttttttttaagatggtgtctcgctctgtcacccaggctggagtgcagtggtaccttcttggctcactgcaacctccacctcctgggttcaagtgattctcctgcctcagcctcctgagtagctgggactacaggcatgtgccaccacgcctgactaattttttctatttttagtagagatggggtttcaccttgttagccaggatgttctcaatctcctgaactcgtgatccgcccacctcatcctcccaaagtgctgggattataggcgtgagccaccgctcctggtcagctaacttttttttcaagtagagatactgtcagttccatcccaaccacacggacattgacaactgacataagtagctcaggaaaaaaaaaaatagtaataatcagaagttctaaatttactccaaatgtttggggcattattactggccaagtaaatgcaaaagatgaggatgcaatatatacagataaggtcacaaacggaggattcctggatgaacttttgttgaagcagttaccttacagtaggaggtattgtgtgttagtcctcaccgccagcatttttttgaccccatctacatgcacttagtagatagtccttgatgtgtctgccttaaggaaaccatccttctctagtttttagtgcatatgttggctttcacctattttaatactgtttgtcattataaattgaattttagcccctaccctcacccttacctggaagtctataaaacattttctcataaacttttgtaacacaattcaattattaaaaccaattatactgtttaaaataaaagcctttagaaggcttgtcagctacttgatatatataatatttaaaggaacttcttccctttttagtttctttagagtataattagtttctctagaaaatgcctggatttttggaaaaggaaactacaagtaatttttttaaaaccaatatccctattcagacaaccaaaatgaaaactcctctctagcatttggatttatcttttttaaagaaatgtgtttcttgtattatgataaatcctgaaatttaaaatgtccattaaataagaaacaccttatgaagacaaacctgaaaatagactgcgactagcaattaagaaagcaggaattgacacccagctatcttgctcaccactatgtgaccatgaaagagttattggtggacttgagatgtttcacagccacgtccctttttgtcatggtaagaatcaagctgtcccagtcatctatccctatccgtgtgcaaacctccatattcctctgagtttcttttcttcaaacctccaatcttagctctctcttccactttaactttttcctatgagatctctgatctaaagaaaataaattctcctacatgctcagtttccacaagcctctctcttcaccttcttccttcagccctcctccacccctcccataacaatgccacctccccgcacacgtgcgcatcttctccctcattccaagtttgttctttgagctcatggatacatgattggctccctgattctctcctacccacccagtccctctattaggactattctttgtccttccatcttaacactcaaggtccataactctaatagatatgcaattgaaactgatattttcaatgcaggcactcctttgtttcatagaacttacctggaacacatcatctttcaaaaactctactaatatctgcctatgctaaaaactaaagaaggaaattatatctgcataaattcatgccattaaatctttaaggtttcaaactgcaaataagtttgaatcctttccaatgaatctatccccttcctcccagtgtgtatatcacatcataataattcaagtcttgaatcccatgactcctccatctcctttaggagaaaatgaaggctgcagtataggaactagacttattctctgcccttgaccctacggagtcagttgcatctgcaaacaacttcctcctcttcgtccatcacagaagtagtatccacatttccacgtaaggtggcatcctgggtcctgcttcttcctgaatccttgaagatttgaatctatcacttattatcccctctagtatttccaatatctccttatatcctggtctttcttgtgattgtctaaacatattcaaggctcacctatattagaacaaataaacaaacttctcctgaccctgtgtgcttatccctctactgtcttttctctccttccactgatacactaatttctttgaagtgatgcctgcactcactgttgccaccttcttattctccaggtatctttaactcactgatctatcctttcaccaaaactgttctcaccagggtcatcagtggtctctgctgttaaatccagttatttatttttttttctttcttgacttctgcagcatttgaaatgataaattatttcctccttcttgagactctgctcctcatgccacttgataccataatttcacattttctaataattctcttgcatctattgctcagatttttataaagacatctctccttcaatagttatacctctgattttgtagcccatgttcctgtctttatttttttctcttctaactctgaactgttggtttctaaccatttcaggaatccgttaaaagccaagaatatgtcaggaaaacaaacatatgcgatgatttgtttataaaatgtcagagtttttatcaactttctaaaagtcttccatggatcccacttcatgcattctctcacatgttcacattccctgtcatgttttcaggaaccactcatatgctatttattcactatcactgtctccagccatgactgccaccttcctacctagctctatttgaatgttctcccacatagctcgtcctcgttctgtccaaaatgaaacccaccagcttccttcctgtaaacttgattccacccttaccactggagcaaaaactccataagccaaaagatcttctctatcttttatggctttacttctaaacccagaggagtgcctggcacatgataggcacccaataaattttggctgaatggaggaatcaatgtgttttagctcaatagatggctctattatttaagcacttgacaaactataaacctgagtctgcttccttccccacaagcctgagtcattttgtctctagcttcttaatttcacttttttttttctgtagtgctataatggcctcctcactccctctgtccttacatcctctattccatgtgttttcaatattgctagagtaatctttctagagtgcaaatatgtttatgcccctttcttcttaatttttttccagaaattctgcatggcttttcagaaagttcaaatagcatagaacagaggcctataatggtcttgcttgtgctttccttccatctatccctcgctgcttttccctgatacagattctatgcctgaccttgctacaagaacaactaatcttgctttcctgaacctgtcttgttctcttcaacttcaggccattgctcatggctttctgcttggaatattaaatgtgtccgcctctctcgaagtcactgctcaggactcctgccatatgccctttccatggctgctcccttctcactctccagtctggaataaaactcttttctaaatgctttcatggtaccctgttctcacccttatcctaacacctgtcacattgtgatttaattgtttatgacagtcacgtcacctcattctctactaaagggtaactttcatcattgcaaaaactgtcttatttatgtttgcttcccttgtgtttagtacagtgctcaataaatagacacggagccaattaatcccatcgctatcagcttttgttctctatatggtccggttctcccagatgaaattttcaatattttggattcatttcacgcatttcactgccactttccaagtaagcctgggtcatggaagatttccctaatgcaggaaatgaatagaataaatgcgtacatagattgtatgccgtggtaattaaatcattagtgctgaacagtggtattgagactggaccatgttaacatatgtttttattcattagaagcaataagtaaagatgaaacctagtaattatagactgtgaatacaaaggagttatctgggtggtctatcataagtcttgaacaaaggaaagcaaaaggcaaacaccagtatttctccagacttccttagtaaatatgatactggcattctgatattctgtgctaattttaagaatcaaactggtagtatttttgtatgtgtaatgccattgtttcaggcattcattttcagttttgttcactttttttggttctctcttcaacttcccatccttatctttctctgcctcccaaaccctccccctcacgaccctgatatcctcagcccaagctctcacagtctccctctaccattctcctcctccaagtcctttacctcctcctgtcttaccttgccccactccaccaaataatgccagattcatgtggtgaaatgtttgtgttaccaaatgtattacatttttatttccactgattgtttttttaaaatcatatattgtgaacatatttgttataaaatatcagtattaccggtggtattttagtaatgcattaaaaaatggggtgatttaagatatacacctctatagtgatggaagtattcttgcctctatccagggcatccctaagtaatcaataaattaatatatttaaaataaaaggaatttgtttgatacatcagttccttgtgggtaagtggaaaatttgttatcaaacgaaatacgtaaatgagcagtaaaggagctctgttatatgtggcatggaaaagcactagtaagatattctcagactgctcatagacaagaaaatcaagaacaatcttttcaatagacatgaataggtgagttcaacgaacaacctaaacctaacctaatcttaaccatcctcaacctaatcccaccaaagagatgagagaatgtttttcctttaagtcactgaaatatggcttcctctttacagctggaaagactataactatgtttgcatattccaatggcttcgaggatcatcagagctcagggcatggaaagactgcagtgtaaactcactcattcattgcataggcaaagttttcttctggcctcttcagtgacttaacaagttctggctcaatacagtataaatcacacatgacacctcttctgagacagcagtatcaggtgtgagttggggtcctctagtagagttgtaaagggatcagaaagttctgagctgtgggcctgaacagctggttggtggtggcaacagcagctgtcatgaagaaatgcctttcccccaatgtgcttccctggctctcctgtcccctttcttgtcaatagccagtcaacatgtattgattgtgcagaggctaagggcttattcttctgtgcatgcttatccatctgccccttttcttttgacttacattgtctctccagggttttatttcgtttttataaacatctttctatctgcctgcttcttctcaccatatggcaattctgatatgtattttttgttggggggaatgtgagacagaaggagaggagaaagagtccctaatgacacaagatttagaatacttatcataagagtggatggtttaataaatactgctttcttcagcatgattttaatcagatgactactaaacttcttttcaaaaaaaaagactaatattcataaaaacaaatgttgtctacagccaatgtttctaactcttacctgtcaacattagacaattcaatctgacttcttgccttcctactccaataaaaccattttttccaagtcacaaatgacttccacataaatctaaagagcatttttcaattctcatcttactacactcctcagcagcattccagactcttaatcatgcctctttcttgaaatatcacgtggctcttatgacttcatactctcctagatttccccctctctctgcaaccacatctcaagctctttcaacagctccattgtttcatttaagctgtaaacattgggattgtccagaacttttccctcactcatcttatcatctcttctctacttactactatctgtaattgacctcatccaactttgtggcattaaatacaatctatttgcttacagttcccaaagttctatctctaactaagatttctctttttgagcaccagactttatatctgactgccttcttgactgctctacttggatttaatctgaatgaaactaaactctcaaagaaccccaacaaccttttcctcactcaccctgctcatcttgggaacccatctcctcacagttgttcacatcggaaatataggagtcactcttgatttattttccttccatcaatttctaaatgaaatgcttctgtagaaaattgcttttaccttccaactacatcactaattcactttttttgttttttaacatttttccctgtcaccgctatagtctaaatactgtcttctccagcatggaatatttcagcagtttcctaagtcgtcttttccattcatgccctcccaattattttttttttaatctagaaagcatctataatgagcagtaaaatgttaaaccctgaggatgtcactgtctggcttataattcttcagagccttcctactgaacttgtaataaacttcactctcctaaacttgcctccatgttcctcagtgatccagacctgctgatttctttgtttttatcttgtggcccacactcactcagccccagcagactcccctggctattctccccatatgctgtttcctccatctagaaagctgtgccctctactcttcatatccaggcttcttctcatcctccaagtgtcatcttacatgtcagtttcccagaagaaccttcctgacaatccaatctaaattagtttgtcactcacctttttgtagtctctatcatactatttttcttcatagagcctatcacagcttgtgttgtgtgtgtgtgtgttttaacaaccacacatgtctagtttaaacaatcatacaactagtgcctaacaatttacctggcagtgaaaatgctgcagtccccaccatcataatcattaaagatagactagtgttgtattaacacggatgatctgtatacagtatggacaataagcatgcataaggtcacagtagaagtttggataactggtatcaatcatagggtaatttgagaatatagtgaaagcaaagcagagagggaaagtatagaagaaaagggaggactatggtatgtgggcaaccctggggatcaaagtgaaaataaagaagatgcagtaattcacagaaaatcaaacccaaggaataaaaaactagattcaggcatgttttaatatactggaacatctagcccagtgtttcaggatggatgtaaaacatcacttctgaaataatgccgacaattctgttcagtctgtttaattagcttgttaaattcacgatattcagtttagatcatggtagatctaaattagggaatgctctggaggaaataccatgagttgaaaaaaatctcctctctcctgatagggatctgccttaagctactgaaggtgccagggccctggaggaatcctcaatgtctgtggtaaatgttttggtgggctaggtaatacccagttcatatagccaagcagtttgaagattgagcccagctcaggtggtggaccctacttagcctaaacctgtaatggtcatccctcaagatttcacatttaagccatggaaattggctaaaggagtaagcatgtgaccttatttgggccaatcaaatgaaagtaaaaaatttggagggattctgggaaatgtttccttattagtagttgagaaacacaggaaggtataatattcttccctcagactttgttgcatgcagatgtgaggtcagagactggttaccactttaggataaaaccagtgcccagaggaagggagagccaagggaatttcaggggaaagagactcatcaccagaaagagcaaccctaaatcaggccttctttagactcccagttaggagggcaatgaatatttttgtaggtttagccaatttaaatttgacattctcttatttgctatagaaagcatcttaactaataaaatgtccaagaaatacatgtatgaggagggaaaaaaaaacaccaggtaggctgtttataaaggcaaattttggaaggtggcaggatgatctgttatctccccacactccagcctttgggttacagtggggagaaagctgctgatagtttcctgacctcaatggttcaagctgtagcagaactagaatgggccaggtagtgactatatttctctcatgtttgctgaacaaggacactttattaccctaactttcagtggacatttttaattttcctaaatgaagaaaaaaatgcaaaaaaagaaaacacacatgtaagtttaaccacattcaataagcatagcacttgtcatcagataattgtaagacattgtaaaaataattctaatggcacttataataacaacaacaatagaaatatcaacaataatagcaaacatttagataggccttactatgtgctggacaccattctaaacactctcaatgtaattaactccttcagtctgcatatgaagtaggtattaccagtttgttaaaattactgataaggaaaccaagacagaggaagttaaatgacttgtccacggtcatacctccattaaatggaagaccctgttttcaaaatgaccattgtattctagaagctagggcttttaagcactaaccaagattgtcagttattgtgggtatataaattgaaagagatgatgaaaaattgcttttgtgttcagggagctcacagtttgttgtgctctctgtaagctcagccagtaataagaatacttgcttccagttttaaatacagtagagacaatgtctatattatgttatgtcatacattccacaatatttttgtgactgttggcgatttcttattgattgctttgtcaatataattttatatttatgccacccaaaaccacttctcattttcaagctacattaaaataataaaggacataaactgcaataagcatttctaggggattaaatattttcatcactaattttaccctataagagcatgatacatgcttcatttaaagttttaattaccaacaaaattttatgttttattattccagagacatatgaagcagttttatcacatgagccttaagtatcctctaagaatcagcaaaaaagagattgtttcctaggtctacataaccgatggctacattattatccataaaatcattcgagaaaacttcatgtgtggcagtatgagcatgtagactgtaaaatatcaaaaatgactctatttcatatgctaacaggaatagtccatcatgcagtttaacctgggacattagatagctttaagtcttttaagcctaagtgaagaagggtattgcattaaaactcccctcaagcttccctgcagacactttgagcataccatccctatcatcttggagagtagatgtaactaggtaacttccccagctgcagtaaacatttatatatgttggtcttctgctcccagaggcttcccaagctgctctgtcaaatctgttaatgtagaataatcaagccaagaagaaagactgcaaggaactgagtgcaaatcaaaaatgaagcagagaagacaggagtaagaatgaaaatgattaaagatcaattgatcgtcatacatagaaatggaattgttcacatacaaggacttagaaacaaaatcctccttaaatgaggaaaaatatacaagtcattttgcataggtcctaggagaagggattttacatattgatactgcttctttacaataccatgcttccttccagtggttaatataacagaagtgcatatcttgaaagctcaaagaagttcttggaagtataggaacatttaacgttaagttgtgatttgtggcgagtacatttgaaaaatattaattgatatttatttatttgaaaagtcttggtttggcttaacagcctctctgcacaattaggatatccagtttctcttataagggaacaaactttggaatcttatctgattccccttgtctgacccctatactcaccatcactggaaacttttttttttttttttttttttgagacagagtcttgctctgtcacccaggcttcagtgacatgatctcagctcactgcaacctccacctccctggttcaatcaattcccctgcctcagcttcccgattagctgggattacaggcacgtgccaccacacccggctaattttgttgtatttttagtagagacagggtttcactatgttggccagactggtctcaaactcctgacctcagacaatccacctgccttggcctcccaaaatgctgggattacaggcgtgagccaccatgcccagcccactgggaatatttaattcctatttgttgcagtaagagcttgtgtgtcagacacagaagctatcattttttatcctatcactgttaactatgtgatagtgcataggtttaatttcaagaagcatcagttttattacttaaaaaatgcctacctctttattttcagagtgttccagagtccctgaaataaataggtgagagcacatggacatttggtaggccctcaaaacacattgttatcatttcttccttccctctttttctttttttccccaaattctggaaacaatcctggatttcatgttttagagtggcaaacagatgaagaaaatgacatattttatagtattttccattcaagcattgcaattattactttatatgtactctcatttaatcactgatgtggtctcgctgtgtccccacccaaatctcatcattgtggctcccataatgcctatgtgtcatgggagggacctggtgggaggtaattgaatcataggggcgggtttatcctgtgctgctcttgtgacagtgaagaagtctcacaagatctgatgcttttataaagggcagttcccctgcacatgctctcttgcctgctgcctttgctcctcctttgctttccaccatgattgtgaggcctccccagccaagtgaactatgagtctagtaaacttctttttctttataaattatccaatcttgagtatttctttatagcagtatgaaaatggactaatacaatcactaaaatagccagtaatgtagttattggtatccctatgttacataccagaaagtgaggttcaaaacgttctactaacttgtcctagaccatttatttatctaaaaatatttgctgagtgtttgccatgttctaatcattaagcaggggccatagacacaaagatgactttactaaggtttctgtcctctacaagatctcactgtggtaaaggacgggggaacagacagtattaatacactgtaatagaggccaaggccagaagaggcaaagccctctgactcattttactacaccagcctgactcttgtgttcaataatattctatcgatctaactcttagctattcatagtgtaagtgggatcttgctttttcccctgggactcaccccctcttcagaggcatatctctttttagggtagtatatcttcccagagcacaatgccacacctttaccttcgctacaacacatcacctggtttcatcttttcccctggattcatctacccaatgtaaatatgcatctaaaacttcctatgtatcaggctttatgcgatgctctaaagataaaatatatacatgagaataattttttaattgctgtgcttgacaagtttagaatattaaaagggaagactgtcattgaacagataagaagaggaaaatatcatagatactgaaatagaggtatgtaagagatgaagtcaaacagacaaataaaaaagctaatctgtattctctgctttgtgttacagtgggttaaggaaaaagatgaagggttttgttgtaatatgttgtgattgagttgattgtggtacatgccagggtcctgttcaggtggatatttagaccttgaactcaggggaaacatcttgcttagagatatactttttagaatatttataggtgtcacttaaagatatgaaaaggtggattgcccagaaaagttgaggaagaacaggacaaagatgagcaatgacagagaaccagcctttgtgggggacaccctcaaccacaatcagaagctcgtccacagcccccagttttgtaacaaaaccacataccagaaaagggttgaatgaagtctattcataatactgttaagaaaattcactgaattgaaaatttttatagtttttattaaagccaatgagaaagagaaacagatgaatgaaaaactatgaattcaagacctcaactcatatcttagtgctccataaatgctttagtttatgagtcaaatagtgatattttaatttcaaggtgggatcttcaaaagctttataaatattattagctgtatagctgtaactgttatcattttagcacctaactcatacaattaacctttttttctttcaaatcatcagcatattaaaatactacagtgattggttgaattctattctcaatctgttttgagtaaatgtgctaatcttaaaagaaaaaaatgatactttgtatttcttatctttcagtaattaaaacaaataatctaatcgttacatttttgctacataatttgtttttttttttttaatttgaaaacttacccctaagggggaaaaatattcttgcttcaacctttttactaagacctagccttcaagagagaattataggaaataggccattaggtgttttgaagattgcttaatgcagcagttcccagggtcttatgctgagatagtaagtacccaggggtagtattatggggtgggagaaagcatagttcatggtaaaaataggtttggaatagccttaagttaaaaagagtactgtaggcttctcagagcctttaatgggcttgtgttcatgtcaaattctttagaaaaaaactggcttaaaagtactgatcaaaagaccatagaagataaaagaaaaaaaaacatggcagaaaccaacttgagtgatgcagtcagataaaatgaaaagcagaaatgaaatgacaaccttagcctgggtgtgtagctagagagacagaaggtgaaggtcaatttcactgcattacaaataaagcctatgtctgactttcagggaaattgctgttggctttatcaaatgtctcttggagtccacttccccctctaagtagagggacctagtctctttcctgccactgcatctccagtgcctagaacagtgtctgtcacagagaaaatgctaaaacattatttatcaaatagagtgaataataaataaatgacagttaaagcataataactaaaattatataatttggagacttcaatggatggcccacttgtacaaatgaagacttccaggtgtttcctaatcctgtctctatcctgagggattatacctaaggggttttccacaggaaaagtttgcacagccttggcaacctgccactgcacgtgaaggcacagtcaagagtggttatttgtgagaaaacaataagatttgaagagagtttgactgtcctttgcacagtatatttttgctcattaaataatgttaattttaagcttaaccctaaagcttggatttttatattgatattgcctcacatttataaaatagttttcagttctcttccaaattgattagctctatcagtcatgaataaaatgacaaaatagcccattgcataaagagggaaaaaaagcaaatcatgtgaatgattttcccaaggtcccagaattattttacagaagacccaagattagaaccaaggtcttccaacttctctattcatcgtaacacacagaagagtgaacatgaattccatctggtttgagaaatcccctgacttgcagtggaatggaaactttcttttaaaaataacctctatttaaaaagaagtctacatgactaattctcttaaaataataaaacaataataagaccacataaaagtcatctaaaaagcctggtgaagagaagatcaaagatgcttatgtaacgacaagatagaagccaagcttcagaattcaaagcttttgtgagctctaatcattttgcttgcattcataaaatcttaaacattttccctctattttttgatgtataatattcaatcaattgtaatggaatgtaagtggagagggctggtaatggctcctaagcatgaaagtgaaaccatggcccatgtgcagcgctgccgcccagaggggagaggcagccttttccttcgtatccggatccttttagaaaagagatatggcctgcgactgactggtgccacttttattccttttcttataagttaattgaaatagaagggctttgttttttccccttttccactctaaagtcaaaggcactgactaggttcactgctgggctatagatgtgtgtgttctttttcaatagaattgtacatttccttataaatatatgtaatatataatatatatgtaatagatattaaagggatgggggaccattctgtgacatcctgggcaatagcattttcccagtttattgagatttttgaattgcaagtgggattaaatcttcatgactgactcacttcttatgctactgcacaaaagctgagggagttgacatttaaactcatgtgattaaacaattcataagtcttttaaaactgtacattttgacatgaaaagaatgcaaaaatattcacaagctacttagctagtgaattaggagcttttaacagaaaaagaaaataaaagaaggctttttattttttcaaagaagtggttgtatacaaccactttctcaagttttctggtatgtatttatgagattaaatgtataaaagaatgtggtgtcttcaagcagttaaataacaagctcctgttgagaaaacatcttgtagcaacaaaagagcttttaattccaaatttaataaatggagggaggggagcttttgatggtaagaaatggaaaagacagaagaaagaacatttgagggatggtggagggtaaacaaaacagcactcagcctagaaggtattcattttctgtccttaatgtaaggaaaaccataaaaacatctgcagttgaagattcagaaaattttcacagagaacattgggtttttataaacaacaaaaagagtcacatcaaaatttccttccttgaaacatttatgtaacaggaattaggaataggaatcaaaatggttttgttgtgaatagttaaggcagagagtatctgcattttgtattactgagaagatcctgtagagagtatatcccttttgtcacaaaggagagattggttcatcatgtgccatcatgggttccaggactaggacatttaaataaaggcacatgcagaacaaggttagtgaatgaagaggacaagagcagacatccagtcagttaccacgatgatagaggatggtgattgccaccaaaagtcataacgaatgttttgcatgtcacttataatttcatatatatgtgtggtattccccagccaatattcagcttatcttggttaatctctttttgtgtcttttttaaagctcctaattgaaaatgtttttgtcaagatttgttaaagaaaaaagtattctatgaaacattatgtttattaaagaaaaatacatccagccaacattgttattttcatcctagcctgagtgaaaaatcacataagcatatcacttagaggatgatttttaaacagagtctattattatttgaatgacttcactccaatccaaagcacactgggaactgtaaaatgttacagacgctatttcatcataaaggcagtgtgttatgggggaaatcattcttagctgtatgggagaagacatgactcccgacccagccactcattgaccaactatgtcgcaatgggaaaatcacttataatctgatacttttcttatctgtaaaaaaagagaagagaattattctatatgctgggactaaagagaataatgagtgaaataaggcatatgactattattatttttgttattatcagcataaataaaactcatagcactttgtagtctacaagttactttcaattgctttattctatttaattctcacagcaactctctgaaacaggttttatggtctccatttttcagatgaggaaatggagtcaaagaggtcagcacctgtgtgatatgatcaggaaaataaagtgccaggactaaaattctgattttcagatgccctacatcatgacccactaccccaaatcatttcattataaatattctagtttcatactaccttacagagtcaacaagggatgttaggcattccacatctacctgaataattccagcaattggggtaccctttcctcctgaggaaacccatctgtatgtcactattctcattttttaaaagttctcctttctcttgatccaaaatccaactctttgtaacttctgcttatatttttctatttctgtcttctaagaatgtacaaaataaatgaaattccttttcaactgaatgacttttgagttactccaaacttttatctctcttctggaaactaatcctttctaaaatacttagaggatacacttgctagtctcctcatcacaatgattttttttttaactctggaaatatattagttgtcaaaggcatctttttgttgtgtccaatatagcgcttataatattgtgtttgattttatgttaatttatctatctctcctattaaattatgtgcttcttcaaggtggagaggggatcataatatttattttttatttgtttccctgagacctaatataaaccttggaacataaaaaacctttaatattgcatgttaaattagtacactaaaatattaattgaatttaaccctaagcagcatccccaaaattgatacttaattatagaaattcaatttatagagtgaaacaggccacagttcaacttgatcatttctttagtcaaggctatgatgtaataacgggctcttaatttgcagaaaggaggtagacactgtcctccaaagctaatggtagaatctaaaaagacttcacaagagaagtgacaggccattttatctggaattggaagaaaaattatgcttttatgtaaagcaaaagcagtaagagtttaattctacaaaatacattgggactatattatgtaaagttttggaaattggaaaaaaatggctaggactttacctgctagacaatagtgacaagcaaaaattgctaagcagacaagttatgtgatattaatgatttcaaatatgtccctgaagctgacaaacccattctaaatgtttttcagctttcccaaatcgagatgacgagcacctgaataagattattgacactctgaaaggggagcagaggtgaaagtcatggacatgacaaagagggaggggaagtggtgcttttggggtgctacatgaaggttaaggacatgcaccaaataatggaaggactttactccgttaatttattcatttaacaaatatttattaaatctttactacagatatggttcctgttcttatgcagcttacagtgtagtgcaggaaagggcacgatttaaaaggaataaaagtaaggtgggatcagttgtaaattgggccagcttcacaggcactcggccagtacagtcacacaaggccgtatgctcagaagagccaagctcttggagtttaatgttctgcagtcattgtcttgaaatgtttaatacttttatctttaaatctgtgttttataattaccatccaatgagacaatggagcttgtgttggaggtttgaagcttcagctttcatgcagttctggctttcccttcctctcccacctctccaggaaggttcttagctgcctgctctctgcatcctggtgtcccaggccctgtctggccttccccttcctgccccaaccactgccaccctccaagtaagtggcaataggtctcagtagcagaaggagtcctgtcctctgccattgcctccagagggtgcctgggcatgagcacaaggacagttgagtggatgcacacctaatggcatcttgaaggcatgggggtgctggtgggagcagcgggaatccgtgcctcagagggcagtgccctggcaaattcggtaggtgacttggtgggtgcctcacatctaccctctagcaagcatgtcccagaagggggattgtaatttcctgggggtttcttatccactgtgtatggagacggtggcccatggaagggaagattgatttcccctgtgacagtcagggcttgaattcttgttttgcacaaggatctgcagacaatatagcaggccctgattataaaacagctgaagttagggacagtctataagtacctaacccggtagggagtgtggaggcctcatagtttccccagacatttaatctgagactatatctaagaactggtaagagttatccaggcagaaaggaggatgaagaaagttccagaaagaaataacatatgaaggcccagggttgaatcggagcccagaaagtgttccaggaactaagagaagttgagtgtgatgggaatggaaatggtgagcaacatggaggcaaatggcaagtcacggttagagcggaggtcagcagctctgccatacaacaaaagggcttgggaagatagctggaggagtagcaaaattaaagagtgttgtctcccagtgtttgctgtgtttaggatccatcttacctaccctgtgcctgtagagtccatttttgacatttaaataatggttgttacagtattttctgtaatatgtcatgtggctggaatgagcccatcatcctcccattgtcgaacttagatcctggatccttgtcacctatgaatgtgatgaaaagtgccctttttcctcagatttctgcaagctgcatattttgaagaaaagtgctcatcatgaaatcaaacaatcacaagtttatcttgtgcttcatcgccagcctctactgagagaaatactgtagttatttcacccaaactctccctgggagattgtgttatgcaaaagctaagtgaatggacctcaagagtgtaccaaaaaaatgtctccaagttgcaacaaagcatatttttcagaactgacataaagtcgatttttttccttagtaaggattgtttttatcacattgacatttagtttattagagctaactttataagaccagttcctaaagagctttttacctaaatctgttgccattttctatagataagatgagaaaatgctgaaaaagtatggtttttccctcaaagattattcaaaataaaatcacatcatcagttctttaccaccaggaagcggcataattacctcagactttcaaggaaacaggtatgcccagcaattggtttaatttaggcttagaattgttttcttcatccaaattgctagttcatcttctctatccttgatatactttttaatggaaaagaatctatttctattattgacttgtaagagtataattgaaaaataattagcaaggcttttacaaatgaatgcaggaaagagaaaagatatatatatatatatatatatatatatatatatatatatatatatatatatatatgtatgtatgtatatacttcaaaagtagtttccaataaatgccactagtctggtatccaataaatgccacaaaaaattagaaaagagaactaacttttgtggcacttttaacatgcaccagacaagttagatatgattattccaacttaatattcacagcatcccaatgttacccaaaagaaaatgagacagaaagggttcaataaacttgccccatctcacatgagatttactgatagagccaagccttaaattcaagtgtatcttatcgtaaattccttgtctcttctgtctcatgttaaaacattgaaaactaaactggagtagaattctgtgattgaagtataatttgcaataagaaagtcatgttatttatttagtcaataagaaagactttaaatcaatgtatttttgccttagtgtaataattattggatgcatagtgcttaactagctttatcagtatctataatatgatttgtttaaatcatgtctttaacttttgttttaagttcagggctacacgtgcaggtttgttacataggtaaattgcatgtcatgggagtttggtgtacagattattttgtcacccaggtaataagcatagtgtctgataggtagtttttgttgttgttgttgttttgttttgttttattttgttattgagatggaatctcactttgttgccaggctggaatgtagtggtgcgatctcggctcactgcaacctccgcctcccgggttcaagcgattctcctgcctcagcctcccgagcagctggtagtacaggtgtgtgctaccatgaccagctaatttttgtatttttagtagagatggggtttcaccatgttggcaaggatgatctcgatctcttgacctcgtgatctgcctgccttggcctcccaaagtgctgggattacaggcgtgagccaccgcgcccagatgatacgtagttttttttatctttaattttctcccaccttccaccctcagtaggccccagtagctgttgttccctcctttgggttcacatgtactcgtgtttagctcccacttataagtgaaaacatgtagtatttggttttctgctcctgtgttactttgcttaggataatgacctccagctccatgcatgttgctgcaaatgacatgatctcattttttatggctacatagcattctatagtggatatgtaccacattttctttatcaagtctaccaccgatggtcaattaggtagattttatgtcattgctatttgaatagtgctgcaatgaacatatgcatgcatgtgtctttagggtagaaagatttatattcttttgtgtatatatccaataatggcatgctgggtcaaatggtaattctgttttgaattccttaagaaatcaccaactgttttccacaatggctgaactaatttacattctcatcagtagtgcataaacattcccttttcttcactacctcaccagcatctgttatttgttaactttttaataatagccattctgactggtgtgagatggtatctcattgtggctttgatttgcatttctctaatgattattgatgctgaacattttttcatatgcttgttggctgcagatacgtcttttaaaaagaggctgttcgtgtccttagccaactttttcatggggttatttattgcttgttaatttgtttaagttccttatagattctggatattagatctttgtcagatgcacagtttgcaaaatatcttcttctgttctgtaggttatctgtttactctcttgatagtttcttttgctgtgcagaaactggttagttaaattaggtcctatgtgtcaacttttgtttttgttaccattgcttttggtgtcttcatcatgaagtctttgtcagggcctatgtccagaatggcacttcctaggttatcttccagagtttttatagttttaagttttacatttaagtctttaatctatgatgagttgacttttgtatatggtataaggaagggattccgttttaatctcctgcatattgctagccagttatgacagcgccatttattaacgagaaagtcctttgcccattgcttgcttttgtcacctttgaggaaaatcagatggttgtaggtgtgtggcattatttctgggtactctattctgttctattagtctatatgcctgtcgttgtaccagtaccatgtggttttggttactgtagctgtgtagtatgatttgaagatgggtaacttgatgcctccagctttgttctttttgcttaggattaccttggctacttgggctcttttttgcttccaagtgaattttaaaatagttcttttctaattctgtgaagaatgtcattggtattttgataaagaatagcattgaatctgtaatttgctttgggcagtatggccattttaaccatattaattcttcctagccacgagcatggaaagtttttccatttgttgtggcatctctgatttctttgagcagtgttttgtaattctcattgtagaactctttcaccttcctggttagctgtatttttagatattttattcttttggtggctattgtgaataagattgcattcttgatttggttgtcagcttggatgttgttggtgtataggaatgctggcaattgttgtacattgatttgtatcctgaaactttgctgaagttgtttatcagatcacggaacttttgggcagagactatggggttttctaggtatagaatcatataacctgcaaacagagatagtttgacttcctctcttcctatttaaatgacttttatctcttcctcttacctggtttctctgcctaggacttccaattctatgttggataggagtggtgtgagttttgtcttgtgctagttttcaaggggaaagcttccagccttttccattcagtatgatgttggccactggtttatcatagatgacacttactgttttgaggtatattccttcaatgcctagtttgttgagggttttttacgtaaagggatgttggattttattgaaagccttttctgcatctatggagatgatcatgtggtttttgctttttgttctctttatgtgatgaatcacatctattgttttgtgtatgatgaaccaaccttgcatcccagtataaagcctactttattgtgatggattagctttttgatgtgttgctggatttggtttgctagtttttgttgaggatttttgcgtctatgttcatcaaagatactggcctgaagctttctttttttattgtgtctgtgccaggttttggaaacaggatgatgctggcctcatagaatgagttaggaaggagtgcctcctcctgaatttttggaatagtttcagtaagaatgataccacctcttctttatacattgggagaattcagctgtgaatttgtctggttctggactttttctagttggtatgctttttattactgattcaatttcagaactgattattgatctctttagggattcaatttcttcctggttcaatggaggtcatatatttccaagaatttaatcatttgttctagattttctagcttgtgtgcatagaggtgtccatagtagcctctgacttttttttgtaactctgtggggttggttacaatatctcttttatcatttttgattgtgtttatttggatcttttcttatttttttcatatcagtttaactaatgatctatcagtcttatttattccatgcaacaaccaactcctgaattcattgatcttttgtatgttttttcacatcttgttttttgagctttttgttttgttttgttttgtttttagttgtcctttgattttggttatatcttatcttctactcgctttggggttggtttgctcttctttctctagttccactaggtatgatgttaggttgtagatttgagatttttctaacttttaatgtgggcagttagcactataaacttctgtcttaacactttcttaactgtgtcctagagattttgttatgttgtatctttgttctcgttagtttcaaagaatttcttcatttctgccttaatttcattgctaacccaaaagtcattcaagagcaagttgtttaattcgcatgtgatttcatagttttgagcaattttcttactgttgatttctatttttattgtgttgtgatctgagagtgtggtgagtataattttttttgaatttgctaaggattgttttatggccaattgtggggtcaattttagagtatgtggcctgtgcagatgaaaagaatgtatattctgtggttttaggtggagagttttgtagatgtttttaagtccatttggtcaagtgttgtgttcaggtcataaatatccttgtaagttttctgtcttgataatatgtctaatactgtaagtagagtgtttaagtcttctactatattatatggttatctaagtctctttgtaggtctctaagaactttctttaggaatctgggtgctcctatactggatgcatatatatttaggatagttaggtcttcttgcaaatcgaaccctttaccattatgtaataccctttaatttttaaaatatctttgttggcttaaagtctgtttggcttaaaatctattttgtctgaaattagtatactaatccttgctttcttctgttttccatttgcctggtagatttttcttcatccctttactttgagcctatgggtgtcattgcatgtgagatggggtctcttgaaggtagcataccattgggtcttgcttctttatctaactcaccactctgccttttgattggagcatttagcccatttatattcaaggttaatattgatatgtgtaaatttcattccttcatcatgttgttagttggttactatgcagacttaattgcatggttgctttacagtgttaatagtctatgtacttaagtgtgttttcaaagtggctggtaatggtctttcctttccatatttagcactctgttcaggacctctcataaggcagttctggtggtaatgaattcccttagcatttgcttgtctgaaaaggaccttatttctcctttgtttatgaagcttagtttagctggatatgaaattctgggtaggagtttctcttctttaggaatgctgaatcaaggccctcagtgtcttctggtttgtagggcttttgctgaaaggtccgtggttagactgatggggttcccttggaaggtgtccttccccttctccctagctgactttgggaatctgtttactatgtgtcttggagatggtcatcttctgtagtaccttgaaggggttctttgcatttcctgaatttgaatgttgccctctctagtgaggttggggaaattctcatggaccatatcctgaaatatgcttccaagttacttgctttctctccttctctttcataagtgccaataagtcatagatttggccactttacataatcccgtattgcttagaaatattgcttattctttaatcttcttactttatttttgtccagctacgttattttggaaaactggtcttcaagctctgacattctttccccaccttggtcaaccatatccatgcagaactatggtaaagattacataccaaaaatcagaacaatttccatttaccgaatgctgaccatcatattatgctcgacattcatgaatatcctctgttgtggaaagcaatagtgcagtttgaaaaaaaaaatcaatgctgctacctgagggaaaggcaagtgagatggactttgaaagggaaaagagaaagtgaacccaaaggtccaaggtcaagtataccctccaacagatcagagaaaagatgaaaatacagaatgagtaaggttgtgtgaaatttaatgaagaaagaaagcaaaattgcagtagcaatagtatcacaagaataacccataagtgtgagtgtacctgcattcaccctgagatgcacaccaaacccaaacttcccttctcccaactaaataatcacaagttctttatctgcctccaattagatgctgaaggatagagaaaaaagcaaagaaaagtctaaagttcaaaacataatgcacaaaacattttatgactgcttactacttgctgtatcctggtgataaagagaagcagtagaaagaaaatcacactaggaaaagagatctgagagttgaaaggcagcttcccagaatcaagccaagtatatgttttcatgttatttgtgttgcatgcttccactttaagtcataggtacttgcatgtcaaaggtactctgtaagcactaagtgaatcaaacagaatgaaaggggagagggaagatgagattcatttagaagaagaaataagaaggcaatttacttttgcataggtgggaacatagttcagggctctttacactggctaaaaaggaagaaaaataataaagagagaagggttgccaatcacacaaatgtaaatgttcaaagatatatgagatttgaggtggaagatgtatgatcgtatgtgtgatttcctcagtgacaggaaatatcagatttatgaatatactatgctccattttcatctgtaagaggaatttgaaaaggaaatattattttgggtcatgacttgtcttctgcatataataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagattctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgtttttaaaaatgaaaataaaaatctcagtgcaaagaatacatttacttctctagtagactattaattgcagaatcgcaatacatatgatctccttcttctttgttaaccaagtctcaatcacatttggttaacaaataaaatactacactccccgtcatcccttgtagcgaaatgagcttataagtctaagtcctgcccagtgagatgtaagcttactattttgtgacagtctttctgggaaggctgcttaaagggagccaataagtcaaggagaaaggataatcgtttatccttccccacctcttcctgctacaacagaagggatggctggagctatagcagccaatttagactatagataaactcaaagaaggaagctccatgctaaaaatggaatataggaagaaatagactgtatcaccgataacgtcctcgtgccaccagaatgatttatcttcaaacttctcttttaactgaaaaaaaaagtaaacttctgttttgattaagccactctcattttcattattatttccttccctggttatacacatttaaagcttattccaactgatttagtacttggaagtaagtttcttcaagtatcagaaactaaaatgtggcactaaatgtgtaatggaagcagagctgcataggtgcatagcaatgactcagataatgaaagccaaaaatctcatgatctttataataaatctacaaaatatttagtcaagtcatcacctgctacacattggaagccaaccacatgctgccaaaggctacatatagtattaggagaaatggtaaaatattggtatgggttgtcagaaaaatcctagcatgacaaattcgaggtggaactaactacctggccagtctcagagttgaaacggaaagacatgcacctttgctaaggaaggtactctttgcctgtaacccacaatctcagttgactgagagtctggtaatttgaaaactttcatggttgaaaaagccaactgcctataccccaaattgaaacagttaaaagaagcgtctgaaaattctaggcttagcgataaatatgacttttgccacaccatacaaaagttgtgagcctgctggcaaagataatgcattacttcatatgttctcaatgcagcagacagcaagctgaaaattatttagatgcacagagcacagaggtctgtaaataaaagaccagggtcttcaagcttaataattccatttacccaaggtcattgactgtttattcacacttggagatgaccaaaaaacaactacgctgaaagtctgtcatactttttagggtatcttattgtccaaaactaatccagtgggtcatgaacccgtactaaaaggaagtggcttgctacatatgtgcagtccttagtgaagatattctcctgaatgtccatttcagatgtggccacagaggacaacagaaaaggaagaccctcctgaagagcaaatccaggggccacgaaagaaaatgaacaagagaatttttattgaagagcagaacctgggactgccagatggaccaactaaagaactcacttcacaactagggcagtgagtcctcaccatttcttctcagcaagagttggctgctgtaaaatcagagagattattcatgccttatggttaataaaagtatctataggtaactgaaccttgaggagccaaattgaggcctgatgaaggagactgtacatcatccagagagaatgaacttggagcaggatgcaaagactgcaggggagaaatcagggtttttctgctggaggaagaagcagagggtacatagacataaggtatccaaagaagcccactatagaagctgggacagattgcatacttattctcaattcttcactcctccctatgcagtagagcagagaaaatcgagtatacctgtgacttgctttgaccagtggaaagttagaggggacaagagcacaggctttaaacatgcccatatgggacttctgtgcctaccatgagaacatgccccataattgttaatgcagggagaatgaggagatgtggtgcagactcttagccaatcccaagagctgggttcaagggtagccaacactcatcctagagaagtgtcccctctgacctgcagacacatggccaagaaaaatcaatgcatgttgttgtaaaccattgcatttcaaggctgtttgtgatgcagcatcctggctaataaaccagccaggtctattctaacaattgtagctcagagtaaagaatgtgggcatctcatcagcagacatgatcactaaaaagacagagaaaagatacaatgagaaaactataagcaaactcttggaaatccaacgaacaaaatagaagaaagaagaaagattaagaaatttctagaaacatcctacagtggtcgggaagactgagatattaagcctaggagataaaaatggacaggcagattcatatcatgcttaaaaagaaactgcaaatgattgagaagttttttttaaagtggaactatttcaaaagtaagaaattagtaaagggacaaagttgttaatgcaccataaacaagtgatcaaaagcagaaaaaaaaatgaactgctgtggaaatggacacagtgtgatcctatttttagtggactacttgagttttttaaaaaattaggaggaaggtaaaaggttcagaaaatagaaacagaagtgtaaataatactatgaaatgggcctagctgaaacagctcacttttcaaaagaatacattaaatgaagaatacagaatgagatccttaaaaaaagaagtcaggaaagtattacatagagtaactgcaaaggccttctctccttataacacggaaattgatgtatttgagaataagggtattaaaaaagatctttaagagtctacaggaaatagaagagctaggacaaagcatggatgtcatgtagaatattttatgataaactgctgacctgagccaataattcttgggctggggaaaaaaactgtttctctatagataggtgggtgggggtgagggtggggagggaaaattgtaatgcttactttctaaatagatttcaaaggaatgcgggagaacacaaagagaactagcttgcattgttttttttaatattagcattttgttgataaaacagaaagcaggaagaaaaataatgaatcatgcatatagtaataaaaaagtgtggtaggtgattaacgtgttaagagtcaagggaagaactcatcagaagagtaaaagaagagaactgaaaagcaaagggggacaatcaacaaaatgtgaacatacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtgcaatactgagcgctactccttgaaggtgaacaacatagaaatattgttcagtgcaactcaacaaatgtttatttaacgactgcaatgtactgagcaaattttaggctctggtaagacacatcagtaatgaagacaaacatatgcattaactatatcaagcaggacaaagggctctaaagagaatgaatgcagttctccaaacagagatctctgctgtcactattgaatatcttgtaaactctccagaaacgtgtatgtgcaagcatgtgtctgtttgtgcatatatatatatgtgtatattttaatgctacacatttgaagataccttattacactattcatgactttgtgattttctcttaacacagcaatttggagattaccccctttcagaacatagagagagctacttcatttctcccaatagcatattttattgcatggttgtgccataatttattgaattactggcctttaatgaacaattatgccatttccagtcctttcttattcatgtaatgcttattcatactgtgctttacatatgggctaatatacctgttaacacaaatcttgagaagtgaaatttctgtcacccggcaagtgaatttttaattttgatacatagtgccaaatagccttcaaagtgaaacattcacttatattcccaccaacagtgcacaaaattgcttttgtcctcaaacttcctgccaatgccatttattatcaaaccatttgatccttgcaagtacagtaactaagaagctatctcattgctgtttgaattacaaactacaaatctcattgtagtttaaaatacaaaccataatggtcttattatgagcaaatatgagtaggtttttacatatttaaaactcttttgagtttctcttactgtgaattatctgtctataatcttggcctatttttaaaaattaataagttagaagaaatgagccaattttcatatatcttggcaggtttttccagtttcttattttccattcaaatttatttatggttgttttaaaccattttgacattttgatctttttttaattttgagattattgtagatttatttgcagttttaagaaataatacagagagaattccatatacctttcaccattttccctcactggtaacgttttgcataactacaggacaatgtcacaagtaggaagttgacactgacacaatgcatctaccttattcagatgtcagatttacattcacttgtgtgtgtgtgttagttctacacaatgttgtcacagtgcaatttcctgtgtgcactactgtggtcgagatacagacttgtgtttcatcgcaaggattcccttgctacccttttctattcacagtccctccttaagccctgacaagcacacatctgttctccatctctataacttggtcacttcaaaaatgaatggaatcatggagtctgaatggaatcatggagtatgcaatattctgagattggctttttccactcagtgtaattgtcctgcatttgtaaaaaaattggcatttcgaattttggtactatgctatttagcttaaggttcataccaaactttaattgtagatttaaactttttcattgtctttcgtttggtagtttcatgcagttttccctaaagtggaccttgtataattttaataaaattactcttgcttgcttttagttttaatttgtttacctatattttgcttcctgcctttattgattttagatgaatatcataatagcacctgtgtcattttgtggtccaaattggtggtcttttaatgagcaattttatctcattgatatttactgatatggcaattagctgtggcattttatttcaagttctactttctgtatttaatgccatttatttttgctatattgtctatatttcttgtatttgcatgttttacttttataatttggaaagcatattctcttcttcagattttctggtagtaacataatatacacataatatacacatataaatatatatgtatacatttaaagaaaggacatgagaaatgcacatacaattctgcaaaagaacaaatagaaaaaaggtaagaacacatcaaaatatttagtcgtaaaagacatgaaaattataagaaaacccttctctgagaattcaaagaaattttttaaaaagtcttctgatacatatatatgtatatatgtatgtgtatatatgtacacatatgtgtatatatgtgtatacatacatgcatatatgtatgtgtatatacatgtgtgagtatatatacatgtatgtagtatatatacatgcatatatatgtatgtgtatatatacacatatctatgtatatatgtatatgtatatgcatgtatatatgtacatatatatacacatatatatgtatcagaagactttaaaaaattttctttgaattctcagagaagggttttcttattttcatgtcttttatgactaaatatttttgatgcgttcttaccttttttctatttgttcttttgcagaattgtatctgcatttctcatgtgctttctttctgtttgtctttgttatttttgttgtttttccccaggccaactatgcattagaggataatgttagaaagcacatcagtggagtgagttagatattcaggtagcttgcattcaaatttgtgtcttgaaatgtttcccaacaaaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccaccttctctgacattcttttctgcccagcaaggttagtgatgccccagactctgacacagcagctaagcgcttgctgttccaaagtggccctgatgacatttcagaaagtgtaacttacctttggataattctgcgtgctttctgtgaacatggaggcacacacctcctgctgctttcctcattttaactagatttaaatttcataacacttttacagccctccaggttttcatttctgcttctttgttctctgttttggttttaagttggtttcaaagaacggggcagaaatgtctttactctgccatctttaattggttcctgtactctttaatacattttaaaattaaagccagagaaagaataattaaacttccatgctgcaacccatagaagttccaatttcttgtgtatacagactctctctctctgcatttttaagaagttccatacacttttaggaagacttactgtcttctccaccaacctgagacacgtacccctacaagggtacatgaaattccactcaacattctgtgagttcacaccaaagattcataaggctacacattgttccttctatcattttctaaaaggattttcttctcatattttcttgtatggttataaataacatgttcctgttcacagtttgtatttagaacatttgctaggcattttgttttcaatcataatccttagagccttgaaacaaacaaatcacatatactgtatagaatgatatctgcttggtatttctgccttaggaaataatgttcatttttgaggcttcattttaatgtacagcagaatttagtgatatcacaatcccctacacagttctagtaaaactaaatgaaacagtgtgaagctcctagctttatctgaactcccatgtctgaaatctgtcatttgttggtgtttagtttgcctggaatgtttgtttacctactgcctgttgactagcttccaaatcctcttgatgagttgatttcataacagctgaaaataacattgcattcctcacctgtaacaggtggtccccaagtggctgtccatcttcccttgtgttctctgctgtgaactgtaaatcatgtcaagaaacgacaacccattagatgacatgatctaccatcactgcgaggagccacccgtcacaacatgcacacactttatccatcctatgcgcaaataataaatttggtcaaaagattgccatttcatgttctggaaaacatgaacttatgtgagcttatacataaaatattttaatctataatctcatgtatatgtcattatgtcatatttcccagaattcagctgccaaaaataacattaaagaagtagttcatgtcaggtaagatgagaatgccccataaatactgattctgaacctctagcagccatacatatgttaattcattattccacaaatattttgtgcacatattctgtgccaaacactgtgctaggtccgaagaataccaaaattaatcattacaaactcagagtccaaagaaaaaggcagactcacaaataaacagctgtaaaaatgtgtgttgctctatttggaggtattacgtagacattagggagagagcatctgtattagtccattttcacactgctgataaagacatatccgagactgggcaatttacaaaagaaagaggtttattggactcacagtgccacgtggctgaggaggcctcaccatcatggcagaaggtaaaaggcaaggagaagcaagtcacatcttaacatgaatagcggcaggcaaaagagcttgtgcggggaacctccaccttataaagccatcagatcttgggagacttattcactatcacgataatagcacaggaaagtcctgcccccatgattcaattacctaccaccaggtccctcccacaacttgtgggaattcaagataagatttgggtggggacacagccaaaccacatcattctgccccagcccctcccaaatcttatgtcctcacatttaaaaaccagtcatgccttcccaatggtccccctaagtcttaactcatttcagcattaactcaaaagtccacagtccaaagtctcgttcgagacaaggcaagttccttccacctatgagcctgtgaaatcaaaagcaggttagttacttcctagatacagcagtggtacaagcattgggtaaatacagccattccaatagggagaaattggccaaaacaaaagggctacggaccccatgcaaatctgaaacccagcaggacagtcaaatcttaaagctccaaaatgatctcctttgatcccatgtcttgcatccaggtcaggctgatgcaagatgtgggttcccatggtcttgggcagctctgcccctgaggctgtgcaggatgcagcctcccctccctgctggctgctttcatgggctgccattgagtgtttgtggcttttcctggtccacagtgcaagctgtcagtggatctcccactctggggtctggaggatggtggccctcttctcatagctccacgaggtggtgccccagtagggactctgtgtgggggctccaaccccacatttactttctgcattgccctagtagaggttttccatgagaggcctgcccctgcagcaaacttttgcctggacatccaggcatttccatatagcctctgaaatctaggcagaggttcccaaaccccaattcttaacgtctgtgcaccaccaggctcaacatcaggtaaaagctgccaaggcttgaggcttgcaccctctgcagccatggcctgagctctacattgacacctttcagccatggctggagcagctgggatgcaagacaccaagtccctaggctgcacacagcatggagaccccagattcgacccactaaaccatttttccttctagacctcctggcctgtgatgggaggggctgctgtgaagacctctgacatgccctggagacagtttccccattgtcttagagattaacatttggctacttgttacacaaatttctgcagctggcttggatttctcctcagaaaatgggattttcttttctatcacattgtcaggctgcaaattttccaaacttttattctctacttcccttataaaactgaatgcctttaacaacacccaagtcacctcttgaatgctttgctgcttaaaaattttttctaccagatatcctaaatcatctctagcaagttcaaagttccacaaatctctagggcagcaacaaaatgctgccagtctctttgctaaaacataacaagaatcacctttgctccagttcccaacaagttcatttccatctgagaccaactcagcctggactttattgtccatatcattatcagcattttggtcaaagccattcaagaagtctctaggaagtttcaaactttcccacattttcctgtcttctgagtcctccaaacggttccatccaatctcttcctgttacccagttccaaagtcacttccacatttttgggtatcttttcagcagtgccacacttcccataccaattcactgtattagcccattttcacactgctgataaagacacacctgagactcagcaatttgcaaaagaaagaggtattggacttacagttgaacatggctggggaggcctcataatcatggcagaaggtgaaaggcaagaaggagcaagtcacaatcttacatggagggggtcaggcaaaaaaagcttgtgcagggaaactccaccttataaagccatcagatcttgtgagacttattcactatcctaaaaacagcatgagaaagccctgcccccatgattcagttacctaccaccaggtcactcccacaacatctgggaattcaagatgagatttgtgtgagaacacagccaaaccctatcagcttcattctggggtcaggtggtagggacaacacaaacaccaagataagttcctttggagatatggcatgagctgaggcttataggatgaataagaagtatgcttggtaaaagagttcaggcaggaaggcattggggagtggcatttcttggtaaaggagttcaggcaggaacacattggggagtggcatttattgtataggggaaggagcaaaggtatagagttgagaaggaggttagaacacgcaaggaactacgagcaatactacaggagtttacttagtgatgctggggccagtgagatatgtggagcagtaagcaaaaggcaaggttgaggagcactccaggaacagtacgtaggaagccaggctggatcctgtggtcaggagcttctgaagagcttgctgttgtggatatttgcttgcacttaaataacttttgtattagtctgttttcacactactgataaagacacacccaacactgggtaatttataaagaaaaagaggttgaatggactcacaggtccacatggctgtggggggcctcacaatcatggtggaaggtgaaagccatgtcttacatggtggcaggcaagagaggatgagcgccaagcaaaaggagaaaccccctataaaaccatcagatttcatgagactttttcactaccatatgaacagtatgggggacaccgcccccatgattcaattatctcccaccaggtccctcccacaatacatgggaattatgggagctaaaattcaagatgatatttgggtggggacacagacaaattatataagctttattgaggtttaatttacatcttaagattcacttaggtgaacaattcaatgattactattaaattgacagagttgtacaatccttaacacaatacaggttttagaatatttccatcattccagaatatccctcatagccatttatagtcactactgactcctacctccaagaaccaggcaaatgctcatctgctttctatgtctatagatttgtcatttctggacatttcacataaatggaatcatagaatatgtagtcatttgcatctggtttgtttcatcaggcatcaggtttttttagatttacccacgctgcagtatgtatccatagcatatttgtttgtattgtaaaatagtattccatggtatggatataacatcattggcttatcttttcaccaattgatgggcgttcagattgtttctattttttggttaatatgactaatgctgccacaagcattcacatgcaagtctttacacagacatgttttcatttctcttgggtagatatttagggatagaattcttgggtcatatggtaaatttatgcttatctgcttaagaaattgtcaagctattgtgaaaagcagctgcatgattttacaatcccatcaacaatgtctagggttctagtttctcctaaggagttttaacgagacggataatatggctagatttgtgctttaggtaaatcaatctgatagctactaaaaatgagactgaaaataatgagcctgtttaggaagatgttacaataatctaggtgagatctctactacgattcccaactagaccattggaggagaagattatctcagaagaagaacaatgctgctgaataagaacaggtgatttgcttccatcagttgctcagccttgggaacgtgacttaccgtggtgtgaggacaaagcaggtacctgcccgccagccagattagctgaggaaaatacacttcaggtatgtaagcttatgccttcacatctgaaatgtcctgtactaacatatacaccctcaaactttccaacacttatactatcactgtgtcattttttcctggttcaccaactgcatactggacacagtgctgcacatgctattgggtatttttcctactttagagattatgttcatttggttctaaggataattgcaagaatattgttgtgctataagtaaataaatgctatgtatttataaattatgtgttaaaattatactatttctattgttagcacacacagtattaagtcatgtggcccaaatctcatatttcatagcatattatggttttattaggatacagtaaattaatatttcagtgagaaagtatttggaagtacccataagccttatcaacagctcatcccaatgtttcccttcaaacagccacgtggaatttgtgtaaatgagtctaaatgaatgataaggacaatatgatgtttgagttaaaatatcttttgaaactgaaaatgagcagctagccaaaaaaaatctgtcactttaaaaagatcaggaaaaagtcttaattctgccattgtgcaatgtatagcatgtaactaagaacaatatctaaggacaacaaatataaatattgaaggaagttgagtaatatttaattagattatactatatttggtctaggaataataaacctgtaaaattatctacactatgaaactaagctctgtattataacatataaatgagttctctgatcttttaaaatatgtatttctaacaaccttgtaaatgattaatatttcaaaatactgctactactgctgctactactagtaataacaacaattttgaatagccttgaatgtcttaaaagttgtaaaatataattttattcatgatgattaagttccatgtgaataagagaaataaaatgactacaaatatttaaccaaaaataaaagaacagagggtttgtcaaaagagaccaatttacttattaaatagaatgaccatacattacagtttcctggaatgaaacacttttataactattgtcctgatggccaatccagtttagcattttgtccttgattgctttacctttcaacaaagtattattatcaatgttatgattattgttatcattaatgaaaataagccagatggacttttacaacctctacttcatactcccaatctttgttataatcatgtctaagtagcacgagacaaattcagggaatgcagttctcaccttaaatgggagttaatcttaaagaagaccagcagtaataacctatctcttcccatttcagactcaacgtaaccaatacctgcctttcaaggaaaactcatatggggctcactgacgaaacaaagcgagtttgcaaaaaaagatttgacatagtcaattctttgtactcttcagtgatggcagctgccttagtggaaaatgtgggaaattacagattggggtaggtgaattgaagataaaattatttatttttgttgttataaatacaaattttgatataatatagcatcatgtgtaaaacaattttcctaacttaagaaatatgtggaacagaaatatttgaaatgtggtggtgtacaaggaagtgagcttgaagaaaagagggtcccaaaaattcacgttttacaccaagagaaataaaaccgtagtagtcacaatttatgaatatttttacacttgtatatatatacttgtgtatttgtgtgtatacgtatttgcaactgaattataaactttaatgattaagctgatttgaaataattttaggaaatactttagtatggcaatacatacttggtctttttgttgcccataatcaattagatttgagaaataattaacctttgaataacctctttgcaaatttacttagttatcctagcaaagtattaaatattttgtaaatgagtcctgacatttctgattgtatgtttttcaaaattgttggaaatctttaaacaaaatcctggagcatccaaatttcaactactaaagattataattttttgagcacccatatttcaaatatgaaagcttttggcaaattgcatttattgaaaataaagctttcatacaggaagatattgatagctcttaaaaagcaagggatacattgaattgattagatgataagtgggcaaatggtatggaggatgtaattttaaaattctctaagagcatattgaaatgtattaacttttaggaagaattttgatgagcccctatttttcagtaaatttctttttaaacttgtattacattttattttgtctctattttttgttattattattatactttaaagttctggggtacatgtgcagaatgttcaggtttgttacataggtatacatgtgccatagtggtttgctgcacccatcaacccatcatttacattaggtatttctcctaatgctatccctcccctagcctcccacccaccaacaggcccaggtgtgtgatatttccctccctgtgtccatgtgttctcattgctcaactcccacttatgagtgagaacatgcggtgtttggttttctgttcttgtgataatttgctgagaatgacagtgtccagcgtcatccatgttcctgcaaaatacatgaactcatccttttctatggctgcatagtattccatggtgtatattgccacattttctttatccagtctatcattgatgggcatttgggttacctccaagtctttgctattgtgaacagtgctgcaataaacatacatgtgcatgtgtctttatagcagcatgatttataatcctttgggtaaatacccagtaatgggattgctgggtcaaatggtatttccagttctagatccttgaggaatcaccacactgttttccacaatggttgaactaatttatattatgtaccattatagaatgaaaatgaagtcaatgatttgatggtaaagagctgcatataatatgactaatactaaaataataaataattttataagaactgaggtataggcccaccagcataatcaatctaattataactatttcaaaaattctattattctaattattcaactatctgcatttactatcaaaaatgcttcagcttgagaataaatgatatgatcatcccagttttgatcaagtaactattggtggacacttttgtgcaactagatcctaaaataataaaagcctcttttcttcatcatgatagaaataaaaattcctctttccaagtgtctctttatgctcatcctacaggaaattcaattaaagatattatacaatactggatgttaaggctctcaatcaaatgttgccatttatttcattaaattgtcttcgtaacaggctaattaaattattgcccagtttagaatgtaatttctatagcttatacaaccaaacttaatatccttaataattcaaaaacagctatatttttatacttgaaaattgtttctgcatgttgaagattacagatttgcaaatgttctggcaagtgtgagcctctttgaaagtagatcatatccttaaatgaatagcaaataaatcacagccacaaaattgcgtatattgcattttgcaactgatagcctcttagctgctcagactgttatttaaataaaatgaataattagagcagaaaactgaagagaaggtgttatttttatctctgtactcaatagaatgttttcaagacaaaaattagtaaggagcatgcttgctcaatttctttaactttaaatcaatgtttactctctgaacacttatattgtaaatgttaagtagaggcttagaaactgataatactaataataaaaaatgaaaaattgagtaggctatccagttatttgccaatgtttaaaagctatttggcatattattggcacaatttagctgacataactcaggtgcttaatttcattaatttcaagatagtcaaaacatttggcatgaagattaaaggaaactcaaaatataaacagaattaaaataacatcataaaaatagtagttgccgaaataatgaaaaaagtgttaatagcaataaattaaggcacacatcaatcaatatgaaaacatactataaatgatgtgaacaaaagatacaagttaaagaggcaaacagtcaataaatatgcgaaaaattaaactcacaaataaataaatgcaaattaaagtataagcataatgaaatttttgctctccaaattaacaaataatttattatctcatttctctctgtggacaagaatatgaaaaagatattctgataacctcctggtgaggcagcaatttagtataattttttgaaaagtaatttaaggccaggcgcagtggctcatgcctgtaatcccagcactttgggaggccgaggtgggtggatcatgaggtcaggagatcgagaccatcctggctaacatggtgaaaccccgtctttactaaaaattaaaaaaaaaatgagccgtgcgtggtggcaggtgcctgtagtcccagctacttgggaggctgaggcaggagaatggcatgaacctgggaggcggagcttgcagtgagccgagatcgcactactgcaccccagcctgggtgacagtgcaaccctccatctcaaaaaaaaaaaaaaaaaagaaagaaaagtaattttaaaatacatattaataaagatattatacagtatctttgtatgtctttgaccatatgtctatttattttaaaaatccatccctaattatcagaaatgtgaacaaagatttatgcatagtgattttaccgctttttagttataaaaataaatcctgagtatgacctaaatgtacagcaatagagtaatagtttaattaagatgtattcatagaatgtaaaaagtattcaatgatatgaaacttctttatttttaagtgaaaaatgatggcaaaaatatatacctccaatgtatctatgtctgtgtctatctaaatatgttcatctatcaatgtatctgtaaccctttatgtttacaaaattaaaacttagaagactatatctcaaaatgtcatttcttatttgcatcactgttttgacaatgaaaatgtatatttcctttacaatttgagagacattttacaaaaaaattagtccaaattttgtttaaaatgttaagagcagcataagttttgtaggactttaaagtaagaaagtaaattaaggtttttcataagatagcaattaactggtcattttaatctaaccagtaaatttgaattaatttgctgctaatgggtttgctttagtttaaaagtatatggagtgccttagactcttcaggctactataataatataccataaactgggtagtttatacacaacagaaatttatttctcacaggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagataccacctcctgattcgattatcttcatggttaagatttcaacacatgaacttggaggaacacaaacattcagatcatagcatggactatttgttattagtattattattatttcttaattacaagtttaattaaaggaaccaatagctagggaatacagccaagtttgtttacaagtatgaagaaccaccagtgctacaatcacaaaaaataatctatgaaaccactgttgaaaatatttttatgttatattgcaaaaatcactgaatttataccagtgtttatggcaatatttgcccaatttacaatcggaattatgttggtacttttttatatgtcaaagagaatacaaaagtcgctttgtccttataaaatataatcggtagattaaattttaagctcactgaagtacaaataagctatctagatagtataaaaactagttagaaaaaaatttcaaacaaactgttggtttgagtttttttcttcacagtatataaacatttaaataaaaaactttaaaataaacttcacacccagttttctcatgtttaagaaagtcagtacaaagtagtagttaataaagctggataagaagcagattacctggaactaagttctgctctggcacttataaattgtattatttagggcaagttatttaacttctctgttcttcagtatcctcatcaccaaactgggaataataattgtatctacattaagggattattttaaagatacaaagagctaataaaatgtaaagcacataaaagagtacccaggacacagtaagagcttaatcaatactaaccttaattattgtgccctcagtctacactcatacttttcacagcaaatcttgagtgaatagtatttactttttttcattcatttcagaagcatttgttgagtacctaacaatatttgtaattttgaaggcaaatgttggataagccctggtggggaaaaaagacaaatgtaacctattctgacctcaaataatgcatggcttcatgatagagagaaggatcctataaaaaaaaacaaacaaaccaaaaaagttttggaagtacagaaatgtactggctgcagaggagcaggcaagacatagaatctaggcagggggttgggattaggaagggctagtctctgggaaaatcattcatgctctggggttcaaacaatgcattgaattgtcttgaaaaataaagtgaaatagatatacgggggaaaaataatccacacaggcacagatgcaaaagagattgtgatgcatttgaggaaatggaagaaaactgatttggctaagttcaggatacaggtgggaaagagaattgtgaaaattgtggctgtataactaaggagaggtcagattatgaagagccttcaagtagagtaaacgtataatttattgttgtaccaaactatctttgcaagtgagggggagaatactaattattttacccagaacacaagcataaaacaaaaatctccatagtgacttggaatgtatagtacttctaggccatgattactttcatctatgcatctatgttctctccatctttttttttttctttttttgagacagaatcttactctgttgccgaggctggagtgcagtggtaagatcacagctgactgcaaccttgaccttctggactcaagcaattctcccacctcagccttgcaagtagctgggactacaggcacatgctgcgacacctagatatgcatttaattttttgtagatatggggactcaccatattgcacaggttgttcttgaacccctgtgctcaagtgatcctcctgtctcagcctcccaaagtggtggtgttacaggcatgagctacagtgcccattggcatcattttacctttaccttgggtacatgtatgtgttgcataagggagcagggagcacagggagaggagaatctcacaggcaagggggttctggtaccagataaaggagatagatacaaagataagccaaaccacaaatgcttattcagcattcttcctgaactatctttcctcccctgaaactcctttttctttgttttcttcttgtgtctttgattacttttttcaatttcctccatggggttctcttttttaatacgaatttttttctttgcttattttcttttctctaactgtatgtagagagatatgaaggcaaacataaccctccctacagtgtcaatttcaatcttattttaatggttcctgaatgtttctcttggtactgaaaccagcccaacttcctcacagaactgatgtttatagtttttagataaacataaaaattgactcaaccaatcttaaaatgtaaaacttaaatttgccttatctgagttcctttctcaggaaacccactctcaggactcccaaataatccataagtatctctgagtgacttttaggtgcccagtaactatagcctttttcacaaatcagggtctcatatctaatgctgggtccagtaagagactttaaacttcatcttaggccctccaatatgactataatatttgcatgtcactaaaatattgtggtgttaggaaggaagaaggacaagagaaaaattcaaagaaggaacttgaaaacatttttaaagttctatgtaaggaattccacaaaaacaccttttatatttttttcctgcaagaataagaaaatccaacgcaaaattgcttaagcaataagcaaaatgtattatttcacatattaggaagtctaaagtttgaaaggtttgacagttagataattcagtggcatattgacatcatcagtgacctaagtgttttctatctttatgacctgtcatcctcagtgaattgctttgccttttatggacccaagatgactgtaaaatgtagagaggcataaatgcagtctttccttctatgggtctccttaatggactttatccagatggttcccagcagatgtctcttttcagcctatttaccagaactgtgtgacaagaccaagccaacactatcaaggagaatgttcttgatctgattcttttaacccatctttatttacttcttggagctaaaaataatccagagtgcagggacacgagatacctgaacaaacctgagcttctattaataaagaaggtggaaaatagtggtttacaggaaaacagcagtatctgctacattctacattcattctaggttataaaacagttcctcacgacagagctagacaggtgtagaaccatacacgatcaagatgcagcaaatcaaagagctgtgtgtctaagcatctgaaatccatctttgacaatgactatatacatgatatgaaaaaaattttaaaaggttaagtgatagactgatttgagttgaatctaagccgctcttcatattagttgttctattccttcttatgctcctcactaaacctcagtttcttaatcaatagtcggataaaaatagaaaaataatgagaggaaagttctctgtggtaacacttatatgattctgtagtagtctgactgtttgtgcctttaccttatgacactataaacttaatagacttccaactcccagtcccacatataaggagcttagaagccaccactccatcgtaacaataggtaaaaagctgaacaaactgaaaagtcaacaattctttttagatccataaaagaggtgaagatccaggcaaactagtggctccaagattagagagacacacagacaaatacagaaaggggagtcatggcttatctaaacagagacttacaagtggaaaccactgcaggaactagtgccagggtagaaaaacctaaactgtaattgatgaattgctggagaatcagcgtggacaagtcagagtttacagctccagaaggacctaagcataagggagactccatacttttgtgtcttttatctctaagaacttgacccagtaaatattggataaaaatttctttgtgctttcagcaaagtgaggggaaaatgaatcattttgaagcatgctagaatactctcttcttaaaaaggcctccctgaagaaaaactaattaactagaccctaatttcataggagtattatcatagtctaactaacctggaggaaaggagatacccgacttcagccaggtctattattccacaaggcagaaggaaaataccaatgtccagcccactgtagccatcttgtcccacctaaaagcaaagaaaaagctgagatatacttatgaagtacagtctagaggcataggatccctgaaagacttggaactaatcatgagactatgaacatttctcctcccacaccttaccaccacattataaatacttatttacaaaaagctagttccttgaaaagatcagtaaaattgataagcctctaaccaggctaagaaaaaaagagagaggacacaagttactaagtaaaagaaataaaaaaggatatatcactatagatcccatggacattaagaagagaacgaaagggcgggcgtggcagctcacacctgtaatcccagcactttaggagcctgaagtggggggatcatgaggtcaaaagatcaagaccatcctggccaacgaggtgaaaccccatctctactaaaaatacaaaaattagctgggcgtggtggcatgtgcctgtagtcccagctacttgggaggctgaggcaggagaatcgcttgaacccaggaggtggaggttgcagtgagctgagatcacaccactgcactccagcctggtgacagagtgagactccaactcaaaaattaaaaaaaaagggagagaataaaataatactatgaacagctctatgtccaccaatttgataacctagaggaactaaactaattccttgaaagacacaatctgtgaaaactcatgcaagaagaagtaaataatctggatagggctatactttttcaataaattgaatcaataacacataaccagtcaaaacagaaggcatcaggcccaaatttattcactggcaaattctaccaaacatttaaggaacaaattgtattaattctctataatctctttcagaggatagcagagtaaatgcttcctaacccattctattaagccactattaccctaagactaaaatcaaacaaaaacattataagaaaagaaaaccacaaataaagatctctcatggacatagatgtaaaaatcctcaacaatatattagcaaatttaatccaacaatgtatgagaagaattatacaccattaccaaatggaatttattccaagtgtacaaggttggttcaacacttgaaaatcaattaatataatccaacacatcaacaggatataaaaaaaaagatcatattaatagatgcagaaaagtcatttgacaaaattcaacatacatttgtaataaaaaaaaactcagtaaactaagaaggaaatgttctcaacttgataaagaatagctacaaaaaatttacaactaatatcatacataatggtcagcaacatttccaaaaagatcaaaaaaacacaaagatgtctcctttcagcactccttttcagcattatattagaagtcctatctaatgtaataagacaagaaaaataaatataaaatgtgtacagattgggaagaaataaataaaactatctttctttgcagatgacaggaacatctatgtagggtatccaaaagaatcaattaaaaaaactcctgtaactaataagggattaaagcaagtttgcaggatacatggttaatagacaaaagtcacttgtcttcctgtatgccagcagtgaacaagtggaatttgaaatgtaaaacacaatacatctacactagcacccccaaaataaagcttgcaggtataaaggtaacaaaatatgtacaagatctatccaaatgtagagaaaataaatcaaagaactaaataaatggagagaattccatgttcatgggttgtacaacacaatgttgtcaagatgtcagttatccccagcttgatccatagattcaatgcaattccattaaaaatcctagcaagttatgttggggatatcaagaaatgaattctaaagtttatatgaagaggcaaaagatccagatagccaatatagtattgaaggagaagaacaaagttggaggactaacactacttgacttcaacatttactttaaagctacagtaatcaaaacagtgtgatactggtaaaagaatagacaaatagataaatgaaacaaaatagaaagctcaggaataagcccacaaaaatattgtcagctgatcctgagaaaggagaaaaaggcaatacaatacagaaagagtcttttcaacaaagagtgctgaaaaaactggacatccacatgcaaaaccatgaatctagatagagattttgcattcttcataaaaactagctcaaaatgaatgacagaactgaatgtaaaattcaaaactacaaaactccttgaagataacatagggtaaaaaatagatggctgtgggtttggctatgatcttttagatacaacaccaaagctatggtccataaaagaaataattgataagctggacttcattaaaattaaaagcctctgctctctaaacagaaagtgtcaggagaatttgaagacaagccacagaggaagagaaagtgtttgtagaacaaacatctgacaaaggattttattcaaattattcaaagaattcttaaatcacaataaggaaacagcctgatttaaaaattggcaaaagaccttaacaggtgcctcaccaaagaaaatatacagatggtaagtaagcctaccaaaacaggtttcacatcatatgtcacaaggaaaatgcaaataaaacaataattagatattactgtatacctattaaaatagccaaaatccagaacactgacaccacaaaacgctgggaaggatatggaacaacaggaacttttatccattgatgaaaggaatgtaaaatggcacagccactttggaagacatttcagcagtttcttataaaactatacatactcttaccatgcaatccaacaatcactttctgtggtatttatctaaaggagttgaaaacttatgtccacacaaaaacctgcacacaagtgtttgtagcagctttacttgtaattgccaaaacttggaagtaaccaagatgcttttcagtagatggatggattaataattcagccaatggaatattcagtgctaaaaagaaatgagctgccaaatcatggaaagacatgaagaaagcttaaatgcatattactaaatgagagaagccaaactgaaaaggctgcatatccaatgatatgacattctgaaaaaggcaaacctatggagacaataaaaaataaaatcagtggttgcctggggaggggggcaggaatggagcatagaagatagttaaactactccctataattctatagtggtggatacatgtcattatacatttgtccaaacctatacacaaggagtgaaccctaaattaaactatggactttgggtgataatgatgtgtcaatgtacgtttatcaattgtcacaaatttgatactctggtgagggttattgataatatgggaggctatacatacacaggggcaggggaaatacaggaaatctctgtacttacctctcaattttgctgtgaacctaaactactctaaaaaatacaaaaaaaaacctctttctaaaaaaaaactctttaagttgaggaatgtatcttcttcattgtgtccccggtagctagtacagtggcagaattgatggcttttaagtatagctaatgactgaaggagcatgttataaaatatttattaaagcctgttctataatatttggcaggtaatagacatttaataattattagatcatagctgatgatttgactcttgacagaactaattgctacttacatttaaataatgctaattagaatgacaggctattggaaagcatgcagaagaaacatatggaagttaataaacctagagtcaaggcctgcccttctcacagttattcaaccctaataaatagctttctcttgctgactctcagtttcctcacttataaaacgagcacattacctacctcataacgctgttgtgatgttgtgatgactaaacatttcttacagttactaagtggctctatgatcacttcaataaaactatgtgccaagtttctatgtaatgatagcctgagaatccccaaaagtattggttgctttccgaccagtcaataatagcttactaatttatctgggatctcatgtgacttgcttcgtctgttccaataaatttagcataaattcaatttgttcaaaacccactactactactactatctaacatttctagtatggctactttgtactaggttcttttctaagtattccatgcattcattcatggaaacacttttattattacattttgcagttgctaaaactgcattttacgtaagacaaaattattttcctgtgtttatacagtttgtgagaagcaaaagcaagttgtatacccaagtttgcctgattccagagtcaggttagttatccaccatattataacaacactcaggcaaagtttacatgtctagttaatgtcaataatggtataaacaggaattaggtaataggccatttttggctctcttagtgagatagtaattaaacattttagctgaaatttctctttactataacataccacttgataaagcatacattaattctagtctggttttgctgttgagaaattatctacatttactaccttattataacatattattcttttcattttaaaaatggccattaggtttatcttacttataatacaaagtgtactttatttattttttaacttttattttaaatttaggggtatatgtgcaggatgtgcaggtttgttacataggtaaacttgtgtcatgggtatttgttgtacagattatttcatcacccaggtattaagacttgtattcattagttattttttctgagtgtattttaatagaaaactaaacactaatgaaatcactgaagatatcataggaatataaaaccctcaagagatgatttagagttttccattttcagttcatggaaggcaaggtttccactcaacagagaaagtacaaaatggcagtcatcaggactaaaacattacaactgtagaagttacacaatgtaaagcttctgatattataggcacaaattacatcatgaaaccatttcactagagcacattagtaaactcagtttccaacggatttcccttggggccctcgccgtattgaaacaatcactatcttaagaagaaaaatgtgttcatttgttcccatgaaccagcacctagcatacctgtcttccacatcataggtatccaataaatgtttcctgaataagcaaatgaagaatgaatgaatgaatgaatgaggaaatagggaattcaaatttcttccagtcttgaaaggattgatagtctatgtggacagagcatagatgtaaatagatttttaagaaaacaaggtgcagacatgaatatttaaagaactttctaaggactacaacaattgatagaaactatctcagagatctgtggggcaggatgtaactccgaaggcttgctatccacttataacctcttccactggctaagggagacagtagggacacactgcatagaaacaggaagaaagcaataattaatgttttttaaagaaaaccattaatagttaattaagaattaagggcccatggtctctgaggttggagtcatttcaaagtactagaaaaaatgagcatagggaagaaatcatattcataagtaccttgctctaatatttccaaatgtacatcaagagaaactgttgcaacttgctgactttaaaattctagccttctctggcttcatgaaaaacttgctagcctcctgcaaagttacagttcaatctgcttcacattgggtaaaacaatacccaaggtacagaggtgctgaaaggcttagttattgttagttatgggagttgacaatcttgaataaaaagcactcttagtgcaaagtagaattgtaatcagtgtcattgtcatttgaaccacattgtttgcagtgtaaccaattgtgaaaccaacataaattcaaaaactaaattagaaaaacagatgcttcttttgtttggagattttagtcccatctagccatattgtatatcattttctttgacttacaccacatagaaagaaaaatcagagagcataatacaaaaatgcagaaacatatttagcaaatttgtggatttcataagtcatttataaactttggatttacaaacaatttcaaaggcttttgaaaatatttttttttttttttttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcctggctaattttttgtatttttagtagagacggggtttcaccgtttttttagccgggatggtctcgatctcctgacctcgtgatccgcccgcctcggcctcccaaagtgctgggattacaggcgtgagccaccgcgcccggcctgaaaatatttatacacacaagaatctctataatactacatataattataccatggcttttccaaagcatattccagagatagactttcggcagaatatcaagtttcctatttggggtttgtcttggagacagtgaacaatttatttttcagtctctgtctccactgatgcttgtgattaagataaatacattggtgcaatgagagaaaagagatttatcttgtacataatttctaaattgacttgtgacattaggaagtcgatctacccagagtggaatttgtttcttcagttcactgaagttcagttcttcagttcactaagttccaactaatttttgtttctccacagtctcaactattttttaaggaaattgcgaagttcacttttaatgtttctgaactaccagacttcctatgatttaaaaaataacaactgtaaatttgcatgaaatctttggcattatatactcaagtatagcttcaattctgggccaatatacaatgctgatttgtgtaggacaaatatctagaaaaataggtatttttgaaaagaagataaatactctaccaatgcaagttcaagatgaaataagagctacatgcacacacacacacaaacacacacacacacacacacacacacatccatctgcatcacatatctcataagcactaagggaaaaaaaacacacttttgtgtttatgatgttaattttaagcaatcaaaagtataagcaataacatatgttttgccaagtttacagtacaccattgtggttataagcatagggatttaagctttgttttcaatagtctgaggtgcttgcattttgtttatatcaacattttacttccaacaatttttttaaaagtcatcttatttgtagtctaaatagttcttggtaaaacacaaaatctcttagtgagtagcaaatcggggccactaaaaataaatttcctctttgttgcaaatgagacaaaaactgttgtatttagactgtgggggcagttaacaaggtctaggaaacctcaacctgctaccccaaaccttttgtctgactacgtggataagaacagatgacaggagagtgggtggcttcctggagagaacttgggctttaactcttattaactgtatttcctagtagagtagcatctgtgcatactagatgtgtaagcttcaacaaatgatcttgccctgagtctgttttattgtctgtaatatgggtaaaatattatatttttatgagattaatttaaggatttgatggcacaatgcatgcagaatcattagcatagaacatatacttgatatttctcaattcttcttgatttccccttcctgtctttctttcctcattttcaaacaaatcaaaataaaactgaaaaagtataaagtatatcacgggaaaatttagaataaaatatattttatttttttctcaacattagaaagtcaactaaaaaatgagcagctatcataccaatacatcgtttagtatagggtagtcagttgacccacacagtaatattaagtcaattcagctgtctttgaataaaaggaaagagtaagcaagcaaaagaaagagagaaagaacaatttaataattacagaggattcttcccaccattctaataatgaatggagtatgaatcacctagcaagcaagagatggcagacatgatttggctttccattcaatcatcacccatcattgaaagatgcttattttcattacaatatgacacctaaattcatgccaactatttcatctgaaactcaaccaagaaaatggcaatctgttctaatgctgaaggaaaatactggttttctagtcttcaacatgacctttcagagagattttcaatggaccttttaaatatacatatatatgattttcttcacacttcataactttagagcttaaattcacatttgtcactctactgtactaatatttaagtacacaacagaatttaacattgtattatcattaaggagcatattagaaagttaaaatattctataaaatatactatataagcaatacatatgttcagataatttgtacttttggttattaaaaagaatttttaacaataggtcatcaaatttttgtagttgaagaaatattttcagattttgcgatttagaattgaaatttcaaaagaacatagacagtaaaagtaaatattagtgaaatattgaactaattagagggaagccaactgagatatttctaaaacaaacaaaaaaactaagtgtatttactacatttgtagggtaatggggaagccaaataattttcatgggtttcagaatgaatgatcaaggtggaaagcatagaaaaatacttgggaacacctgataagcaaagagtaccagccccatacacacacttacatgcaccatacacacccacctgttactcaagttttcagaagtgaagccaccaaaagattaaaataaatattggtgacaaaagataggtgctgctggagtagatcaaggttaatggaggtccttgaactctttgggatatcaagaccaaaaataaaagcttcctttgaagtttgttatctggagaatcagacagacttcttactcttccctggttctagggaccatgtgacaatttatggcaaatgacattagatattaatctttgatatttagtagcatagatcataagcctttttcaaatcaggtagctagaatcatattttcaaagtacaagcccttaatttccgtaatagctacaaaaggtggaggaggacattttattgagattattgttagccagccacccacacacatgggatccaaagtatagtgttctttgcttcatattcaaatctaaaatccagcacatactgagcccatagtgaaatgtgtttacatacacccaacagacgaaagggaggcaacaaaggagactgagaagaaatggctaggattttcagaaacaaaattaggaggctgaggtaatcacttgtctcttcagggatctgctacttcttgaagaggatttatgggatgttacaggtttctgaggcttaccctctgttgtctataactgcttattcatgcaggacaagagaagaaggttaataagtaccctcagggatgtaatactgaaggactttggccctaggtaaataaaaactccaccattttgttcattttaaggctggaattctggtagataagtcaggtaatgtgcagtgaagagctatctatatccagatatcatagaacagattgaggtgtcctagaccatggctcaagatattgcaatgatggcataagatagttggtcaaagaatgaacaatacaagagctgaataaacataaaataaaatgtaggagaagaaaaggaagccatctttaataccagttattataaagaacaaagaatgtgagtgagaaagatagctccttgtaattcagaaaaagaaagaagcaaatgagaaaagaggacataatcagaacttgaggtcaatcagcataataattttagggtatgggtaatcaacagagtaaacttacagtcttattagataaagggaactacatactatgaataataaagcacttatgccatgtgcctcaagcttagaatccagaattggaagtgcataacttaatggaaaaagtccacagaaagtatacaaagctagatagatctatatgtccatgaaatataaatttgtgaggaaatccatgaatcagaaaatggctgcaagctggcagagtcttattggaagcaaagaaaagaaggcatacaagtaatatttatttatgtgggacacttaaagcttttcagccagagaaaatggaaaatgcattactgtcatatatcacaaagcacatataaaagcaaaatatggtaaagatggtgagctttggttatccagatttattagttttttattgctctgtaatgagttaccacaaacttagtggctttaaaaaaacacccatttatttgctcaggattctgtaggtcagaaatctggcacagtgttggcatgttctctggtcaggatgtcacaatgccaaaatcaaggtgttaaactcaattgccatttggaccctgggatagaatccacttccaagatcattcaggtttttggccaaatttagctccttgtggtcttaggactagggtctctgttttccttgttgactatcagccagtggctgctctcagctcttagaagccatctacatcccatgccacctgccacctggttgccttcatcttcaaactagcaactgtgttttgcatccatctcctgctttgaatctctgacttactagtctgtgagcagacagagaaaaatttagttttaaagagcttgtgtaattacattaggcccaccctatcttaaggtcaactgtgccaaaacttaataatgggagtaaaatccatcatattcagagtcccaggaactaggcagggaatgaacacgagggggtgggaaatctcgagggccatcttagagttctgcctaccacagtggacatctgtcgtgggtcttcctcagcaaaagcagaacaaatgatcactggtgacgtgataaactactgacttctccataaggcatgtgagcctccctctgctctgctctgctgtagtcccttgggatactatatcactctctcgtgctgcccttaagagaagcagtaccaaattggaacatgtttagagataaaaaatgttcttgcaactgtgtatagaaggaaagcctgaagggtctgagggtgtttagtgtgtaggataggggtcatagagacaaaattaattattttattgatttaaaatatttgcagtgttgccacaaagtaaatattcactgtgggtctttaaggtgtacagtaacaatgaataggtgaaggcaacaagaaagaattctagtgagagacatagaaggaattactaggaaaaaaattatggaaaatccctggatatacctagctactttatcagatactttattctttagaatataggtaactagaaattaaagaataaaatgaatttatgatcaaattggtaaaagaaactctaggttaagcaagtaagcagccttttcctcccactgcaggatttctcaaagactttattatggtccgtaattctcagaaggaaagatatggcatgcaaaatgtttcaggttaatagaacatcaaacatattttttatttagacacctttaggactggtattttacaaactttgcttggtaaactgctgtgtgttatggggaatttgtgtatcagagagtggttcaacataaccactgcaatctctttttctatttcaggacacatttgggtacttagctagagctgagtcatctttattaatgtgagctgaatatctacacagcagccacagaaaatgagtggtacctatttgaatgcctatgggacttaactggattatatatattctcacagaaattagttagaaaacggtgctcaaaactttgcctcctcaaagtataagtaactggatgaaagatcacctgagcaaaatcaattgtgaaaaacttgttccagattcaacaaaaattattaacaatagtatattagttcattctcacactgctgataatgacatacatgagactgggtaatttataaagaaaaagaggtttagcggactcacatttccacttggctggggaggcctcacactcagggcagaaggcaagaggcacatctcacatggcctcagggaagtgagagaatgagagccaagcaaaaggggaaaccccttataaaatcctcacatgtcgtgggacttattcactaccacgagaacagtatgggacaaaccacccccatgattcaatcatctcccaccggggtccctcccacaacacaagggaattatgggagctacaatgcaagatgagatttgggtggggacacagcaaaaccatatcaaataatgatggaaattaagaaattattgtgatctgctattctcagtaaataattcagaaaaaatctcaatcttcatgatttgtaaatagttgaaagctagtgcacttaatcagcttgggagctgcatcttggctgttctcataaatctcttgttgaggaagttcattgctataaaaatgttagaggttttccctattgcttctttgaatactaatcattccaccttccttttatataacactttgacgaaacgaagctaggactatcctgatatggtgaaatatttctcatagtagattctctgagcttcattatagagaatgttgcagtccaataaattcagcaggttttgtcattttaaaatttttattaaaaaatctttaagataaaatataactaactcttcttagcctcagtataccaaaaagcagatattagtaggaaaaaaaaaatataagggaataccttccgaaagaatctcacaattcctgagctgaaaaaaagtcttctatattcttaattccagctaagcaggtaaaaaaatctagtactaaagagatagcaaggtgtgactggagcccaggccatctaactcagtccaggtctcttacattaggttttagtttttgtaactttgttctattatctatactcctcattatcttttatgtatgtgcgtgtgagaaatattgtaccataaatatgataaatttattttgtaattatctgtcattatataatcaaatgtcaaatagtcaaatgtccaaggtagacatatttagttataatatcatttctagtagcaaaccttgaaatctctaatcatatgttctccatatctatttctcttcactgatgactgattttttttttactaccgtcaacatcaaaatatatggaaaatccattatttcaaaagagcaatttcagaccaattttcaacagaaaagtactcaaataataggctctaatgttcttacatgaatactgtataaatgtgtccatccctgcagaagttcttatcatatcctgcaaaatagcaaagctatcagttactttcggtaaagaaacaatttccattttactctaggcctgtcttttgggttacatcaatgtctgtaattcacatttctaattttaagttaataaaatttgatattcttcctgttaatcattgtaagcatgggggaggatctgaaaaaacgtgagatggggaagacatgttttaataagaaattcctaaatggaacttgattttttaaaaaagaacttgacacaaataaaatattcttaaaaatagaacatctcaatctgtccaaagacaggtaatatccatgtaaaaattctcatattaacccaccaatgtccttcagcctgtgttgagaagcaccaactctcaggttgggggaatagtttatcctcccaggtccactcaattcttggcctataggctgagattgccacctggggagccaattagtgccaaatatgttggtggttttctgatgtaggaaaatctcccctaagaactggactgagatgagccatcaaatgatagtgactttcagtcactaatgatctggaatttagatagagacttttaattgggttaccaagcaacctgcaaatattttggtgatacctgctgagtcaattgggtagtttgtaacccactcttctctgattatgtaatctttgatatgagtacattacatgttataaatgatcagcatggtttttttttctttgtcattagccaagaaaagacatcactgagtcttttgttcattccttgcattatgtttccatgtgtccaaaagagggtacacagagtaaagagtggttatagggaatagagaataagtattcattaagccatcttcttatgccccagtcttctgctaagtagagttagacctcgtgacatcagaaaaggctacaagcaattgttttgtaaatcttatttccacttaattaacagagctggaatttcatgtctgtttcttagatcattttttaaaacataagaaagtgaaatgtgagtgtattgttatatggttttattttaccagagttttattttcaaataaaactttcaagaaaaataaattctgcctctcgttgtttccagatgcctctgtcagttgctgtggtccagcatattcactttttcctgactgctcctgtcatttccttctgtctttcttgctcagctgcctcacatgggtctcaatcagttccttaaactacaaccttgagttgtcttgcccccgtttggggtgggtattatttttcccagtgctactgttctgcccctctggcttttaggtaacatttcacattggctttcaaccttacacgtcgccagatacacagtgggctcttcagaaatgctgccttttccctttgacatgtgtgtgtggtgtaactttcccactgtagacgaagcagtggccagacctttccttctcccagcttttcttctatagccagcttttcctttctcactcatttgaactctttgctggtaggtattcctatgggaaggtgtgcactgatggtctggctttgtgtttctttgagagctttctcctctccctttgagaacttgtaccacgtgagaaataacatcagtagacctaacttttccattcctagttgtattgcaaatgcaagcagtcgagcaaatgataacaaatcatagtgctgtttcaaaggttgcattcacaggacacttagagctctcgactgcatttcaccaatgaggaaaccgagggcccaacatgttaaaaggctagcaaatgttacataattaatagaaagtgactgggaattaaatcttgtctataactcctaatcacatgttttgtacggtacctcatggtgtctcatttgatcactgtattcctgatccagtttcacttgtcactatgtgttctaaacagaagttaaagtggcagcagattcgacatgttttatatagagagatttcattcataaaatacaaaatgaatgacaatattatcaagaagggaaattgaaataaagagaaaaagtcatgtgaaacatatttagttgtgagttgaagctctaaatgcttatacaagaggaaagaatgtcccatgtcattttatgtatcatatacctgtgaaccactgtcaccctgcacaccaaagtgtcaaaaattaagtgggaaaaaatcatacacctaacaagatgttctttcaaaggattatcctattaggtttggggttggagaaacacctttctgttgtatctcaacttagcactggggcttgggaaggggtctagggaaagcccacctcttccttacaaactttcccaaatgtgagttttatgttgagtcccttataagattatttccaagttccttttgagctgaatgatcagctgggttcccattaagagccttggcaaagagaattcttaaatgtgagcttgccaaagtatgaaatgtgatttctgatagttgtttttcctttttcatttttttcctcctccttactcttctctgaccagcctgaaaagtgatacaaaccaggctgggaactacatgcttgcaacagagtaataccctaattatcatcctcttagtaagggctgcttttgacaggtgtcaattagatttaaatggttggctgtgctgttgggttcctttactttccctttttttctacactgtcattccttgaggtagggttaaatgctgacatccctttgtgcttaaccagagataactatcaaagcaatgtataaattacagctccagttacactgatgcttaggaggctcatccacctctaatgacaagatatccaatcaacctgggctatagttttgtgaacagagttgtgaagtttggttaatgaaatctcacatttcacatggttcctgactgtatttttagatactcttacaagtaggatatcctagttagttattctatctttttatctcttgcatgaataaattacagagttctgcttcttatcaaagaaagcattcactcatcatctgggaaacacaaaacactttttagaccataaattattcctaaagaaaatcttagatgagttgggtactccttgttgtgtatgtatatgtgtttgtgagagagaaagaatgtctgcttgatggcattcattctaaatgatcatagacagactacccgattgtcatcttacctgtcagtccttaaagcaaactaccctagaatgcaaacaagcaagccaccaccaaaaatatcctttccaactccttgaccaaccactgtgaatgaccgaatacacccagttcctcctatggcattttcttccggcttactggcagagaatgtgatttcgtggtagactggtagacggttggaaaatgaccccttataatgatggaatttacataaataaatgctgatagcacaaaacagataatatgctgtgggtatcatcacaataagttgtctcccactgacacagagtctaagttggaagcacacaattatgcaaatcaaactaatgccagttgctcattactgtcatggtggtaaaggcaaaaacatatcctccatagacagctcgagacggggccacaagccaaaatgtttggttttgctgacacagtaactgagtcaacaaaaataggatataatagtaatacatcaggggaacccacatcagggtagacctgaagcttaatggactgtgaatcctatgtctgtgcagagcaccctttcactggtattgacccataatacgtctgcttccacatttgccgattatgtagaaatagattacagaagcaaatttttttaagacctgaaatgtctgcaagatattctattagcttttcctaaaacagatgatatgacatttgtaaatacttaaataatgtcacatatcccaggctaaaacacttcccagaatatttcaaagtacctgctgctgtttgatctaggtttgtcctgagttctcattatggcactgaagatgttttcaaacaatagaatgctcatttgccacataaacatctttcctatctttaaaaaaaaatagaagagctgtcaccaggagaatatttaaccctgaatatttcacagaaccttgaaaaaaaatttggccctattgtaggttagtgaagcaacaggtgctgacccaccaatttaatccatttctcttctgaatgacagggtaacatgtggtggattgatgttataaatggccctgatgcttcacccttcatgatattcatgccctttgccacaagattttgctgctcttctcatcaagaagtatctttccttgccccttggctttgagtctagtcatgtgacttgtcttggccaatgggatggaagcaattttgccagaagcaaacgcatagaaaagcatctgcacactgccaagtcagcttatgctataaggacactgtctaggaagaacatgcttggccttgcttgctggagggcaggagacacatggaagagagctaagttgtcctactaaggccggcctaggccagccaacaatgagccagcccctggacagctgagtgagctcaagtcagaaccaactaaatgagtccagcctacatcatccacagattcaggaactaataaatgctgaatgctttaagcccttgagttgtatactgtttgttaagcagcattattgtgttaacagacaactggagagttttcacaaagttttacaatatcaaaaaaatacaagaaaaatataccctataaataatgcaagaaaagattatttagtcaccagatttaaaatacaaacacgggaaaaatggaaattaaatcacaatgagacaccacttcacacctgccagggagaactataatcaaagatagacaataacaaatgtttgcaaggatatgaagaaattggagcctttgtatgttgctgttgggaatataaaatggtgcagccactttggaaaactgtcaaacagttcctcaaaatgttaaacatagcaatactcctccttggtatttacccaagagaaaggaaaacctaggtccatgcaaaaacttgcacaaatgttcatgagagcattacacaaatggccaaaaaggaaacaattcaaatacggatccacagatgaatgaataaacaaaatttggtatatccatacaataaaatattactcagcaagaaaaaggaatgaagtactgatatatgtgatgatatatgagtcttgaaaacattatgctgaataaaagtagccagtcaccaaagcccatgtattgcctgactctatttatacaaaatgccccaaacaggcaattctatacataaagaagacagattgatcattgcagatgtggagggcatgggaattaactgccaaagagtacaaggggtttcttttcaggtaataaaaatgtaaacgtagatcacagtgatcacggtgatggttacacagctctgtgttatgctaaaactcatttaattgtcaataggtgatttttatactatgggaattatatctcagtgaagctggtaaaaattacataaacacttcagcctcatcttctgaccaaaacatggcttgtttcttgttttaggctctcttatatctaccttcttgattggaagctttaaagtgaaaacagaacaaatcaaaagtcttagtattgcttctttagaatcacacacgtatttgctgtatttgacacatttgaaaagtgaaataatgaagaatttttgatgttctataatagacactgatttttcacagaactccagctctgtctttcattttcatgttttctgtgatactcatgctcggcttgctcttaaaactcacctgtgaaaaagaaagggcactacttgccacatcttaggtttgcatatcaaggccaacttcagtgtgtaaacgacacttgcaccaggcatgcttggagctgttcccaatttcgtgttcacagcctctcctccagcagcaggtttgaggtttaacttgcccagttgtgagaactgagtaaatagacagcccgcagtgctgtcatctaagttacctcttctggaacccccactcactgctcccgccacagcttttcttcagctcttcatgatttttgcctaaattaccacattttctggactagctcacttgcttctggtttcactcccctcgagtccactctcctaattgcccccagagtgatggttgtgaagtgggtatcctggccatttcatacccttacaaaaaacaattctagtggcttccaatccatacagataaaagaaaaaatttcatagtataacttggaaggcctttcataatccgacagccgcgggaaatcttgccactccctccccttggagctaataaacatttgctgttctctctcgtgccttcaaataagtgctcccttgtctttatgtgtggtagaggagaagaaattaaaattacaaataaattaaatatattgggagagacagaaatggggagttgctgctcaacaggtataaagtttcattcattcaagatgaaaatgttctagaaatctgtacaacattgaacttagcgttaacaatactgtactgcacacttaaaaaatttaagagggtgtatctcatgttatatatttgttacaatagaatagatgaatttataaatatttatatagatttggatatagctttactgacctctcttcacttgataagccccctcatcctcttgcagtccttttagcaccaactctgccaggaggcctttctaaatctgagatttgtgtcctctcgtattttaagctactggatcagaaactacctgtcctaaacccacctgagcaaagcaccctcgtccatgttgccagcagtgctctatgtacacatgtacacatcacacagcattatcattcctgggttttatttttctgtaaactttttgcatagccaattgttgccagtccatataatgtctttcttttattactgtaattcattttaattagttaattcctgcatcctcattttttcctgccattactctctccctatagccacctgctgtatagcattctttggattcataaacatgtatggattcttgattgtggataagactgtgaaaatgtctgcgtattttacacataattgctattcacctgtctctctgctgctgaattggaagctacttgaggaagggaaaccagccttttcccaacctgaacaccttgcacagtgtctgattcccagtaagagctcaataaatgagtgtcaaatccatgcatgacatgatacattaatgaattaaaagccctacattttagtttaatttctaataatcttggtgggctttacaagttttatctctcttgctacaaatctaaccatgagaacttgcaataagcgctaaaaatcttaaaatatgagaccatttgaatctcagcctcttttgctgcccatgtcttccttctctggcatgtccctgaagcactctgtcccaactgatactagtagatattttagaccatctagtggacagtagcttaaatgtttgacagatttctacttctttctcaaaatggttgctgattaatagctgaaaggatcaaccccagagggaacctgaggtttcctacctgcccaaagccagctttcacattcccatttcccaccagaggactgcaaagatttttcccttgactttgaaataacacttggttttacagtctgcttgcctgtggtttaggaaccgagcatgtcagcactcctttttactgcctcagtgcagcagcaaatgtgttctgttctctcctttcaaaagtgaagattgtattttaaaatcactcttgcccctagggagccactcactcctaactccctgacaggccatgaggacctcaaaattaagaaagatgtccagaaatgtgagtttgtacagaaaggactagaaaaccacccagacatgtaacagctcggttacgtgcctggcttctgtcaggagaaatgtgtgtctgaattttcaggctcataatagacatgtacagctaaccgacttttattttgcctctgtcatattgatctatcagtgaatctataatagaagatgggagcttggaaaagtaaaaagtaataaccattgagatggatagcctgagcagaaatgtagtttcatggggacacttagtgcaaagaactgtagattcatgtcaagggggcacaagtatccccttcaaagccaactgttaaaaacacctagtgcacagatgacctgccttcagaatatgatatgtttctgtattgattttcagagtttcagaacaacaggaaatagccaaatgaaagtttctttgcagagcactaaaagtaatttaccttctgcctttgatttcagcttcagattttgttttatggtgcaaagtacaagtgcttattttaaaaaattcatttctaacttatggtggaaagcagcaccagagaccaaggaagtgtggagcaagaaatgagccatgaaatgaaacaaagcaaaaccccccaaattgcatcaatggagttagtggtaagtcattacacaatgaagtttgtcttttaagcacaggcccactgattggcaggcaggattttaccattatcagaatgaggagcctataaaatgcccaaaactgtggctttgaagtcatctatatttagcttctgtaattccatcttttgtacatccctttgcatgaaaaataaagtgtcatattcaaataaaattggccttccaggacagaagaaaacacagtttactttccagtacaagttggtaccatttgcacatgtttggtctacaataagtactaagcatggggcaatactaataatttgtgagtcttgactagacctctttttttaaagagattattcactttatattcaaataaatttggtttatacagtatatgatgatgcaaggaaacaagtttcagcttattcaatgcccaaacttgaaatttatttgtttccattgttttcttcatttggggctttaagaagttgcattaagcagagttctggcaagaaacagaactcaaaagaagcaattaaagagtttcaacagaggcacaaagcatgggcagggttaagggaattcaaccaaggagggtgaaacaagcattcctgaggctcccaaccaccaccacgtctgaagtgaagagagaagggaatgtttaaagagtccatgcagcctgagtctgaagggaaggccacccaacaggagctggggccgatggaagaggagctcagacactgccaatccatgaaccgagggaacaaacaccccgacttttctttcttcatgtcttctagcttcctaccaggggctcctattgggtgaaccccactgaaaaccagataaaaaaagcttagtttcacagtctattcatatcagcctgctgaaacatacagccaagggagaaagccccagagtgatccagaagggcacattaaaaaaaacaaacaaaaacgaaacaaaacaaaacattgtatcataagagtattttattctagatatgtgctctatactcatagaactggcaatataattgcaattcttcaacttcagcagaaaaacaaaaatgcagctttttgctgcacatatgacataccctgaccaagttaagagagagattcggctttgggaagaacaaggatgaagtaagagtatctataagtgggagaaactgttaagatcttccgaaatagaagttaaacgaaattaaacaaagcagaacaaaagcaatggatatctgttaacctttgccttccacttcttagcaaataaaacattacagcaagcataaatactgtgaaaatactcccaggagccatgggaataactaacctcttcctcactctctgctcaaaaaactctcctaatcagactattggaatatgccccctagttagtaagaaaaacaacaggaaactgggatttgctttaaagacatttaatcatagactatattttaaaatgtgcattatatccacaaaaagagtgatatcagtatcatatgtttgtcaaaacaaggttaaaatgtatatgaacttttgacttttccctgtccaaatcacacccttgtaaggagcccattttattgtaaacatttaaatctgttaggtattagatatgagctcagttatttttgttttgtgtatttttttattcacagatgtttttattatgctttctgcaatcaaatgatctgggttagaattagaggattagaatgccattggatcttactttaaaaatacaaatttatctattttcattaggaacctgacattcttatccagaaaatttacattccatactgaatccaggtattatgtaacacatattggttgtatttttttaaaaaaagtaacaactacttccctacatagataaaatatctatccattatccacctatctatgaatctaaatttacaatgaatcaagtgccaaaaatagcctagcctacttacagagttctctctacaattgccagtcactggaaaaatattcacaatcctttaagtccattaggatggttggttctcacttcagataaaatgataactatgttctgcccaaatttgctttgctttcattctttgcttgcactctcaacaaaaacaactttttaaagcttgaatatttcatgaacagttttgaatggcttcaattgttctgtatttttaaagtgcagataactgtaggaaaaatatatagctaaagatgtctctcgaagtatgttgacactccaatttcattagaacaggattaaaatgtatatttacatgttgtgtgtaaagaaaataccagctttacagtggtaagtatatatgtgaaggactcatttcagcatatgactatacatacacccacatacacatgcatagacataaacacagacacacatatgcacacatataaacatacacttacacacataaatgcacatatacatacatacatacacatacatatacatagatatatacacatacacctatatacatactcatacatagccagccataaacacatacataatacaagtacacaaacacacatatacacacatacacataggcatacacacatatatacacacatacatacacacatatcacatgcatacagataaacacatgcacacatacacaaacacatacaaatgaacacatatacatacggacatacacacatatacacatacacatacatatacacacacacatccacatccatactcatgctgacctgggataggactgtgaagaaaaaagataggatttgaaatcagaaagttggcattcaaacctgattccacctcttcttaattataatcttaaacctacactaccttttaccctatcaattacttctctagcaactcccctgaaccctgtgctctcatccataacttatatatttgtaattccctgaactctctgtataggcatctgccatcactcatttgcttcctaagtaccattgccttaagttcgctcatcacttgattttgttaacttgtctcttgtttcaagtctcagctaacttgtcaccttctctaggttcccctcttgaatttctccaaactgagtcagatgactgcctcactcttactctcctgtggccactgtacatatctcctatatcacagtgctatcccattgtcttttgaatttctgttaccttgcatgtcttctccactggatcaaaattctttggaggacagcaccttttttgtctactttcatattttcagtaccttatatggcacatagttagaatttcaatgagagttttatgaataaatgaatcttgaactcactgaatttaacttttgactcccagcctcaccaaatctttaggtactatcctttcataaagaaatgagggaacataaaattccaagtgtttcagaaacatgctaaagtaaacaacagaaagagtggagcagaagttaaacccaaggctgtcttacttcaaagactgtactgtgtcatgttccctttccaggtagttctccaaacctctgtttatcagagaaatggggctaagaaaactgcccaccctacaaggctgataaaaagaaccagagaaatcatgttagttaataatttggaacagagttacagaaaagtctaacttttttattttacttttacagaggaaatatctgtaaatagcacagagaataagtgaatccgaagagatttcctggacacgtttccttaccccaacttacaccaaaggttctctttaccaagctctatctggccaccttagtttccccctagcatgtgtgctaagcacagatgcactcctagagtttatataaaccagcactgacaaggaaagtatagaaccagaatgaagagtatgaggctcaggaaggctgctcattctatttgtctgcaaaatgccatcagtttgcagtttaaagagagaacaacataagtagagcaaagttcaattgctctccaattagccctaattaacgaattgaaagctgtttgtatataaccaaagataccttttgttttgttgttgtggttcagcaattgagatgagtagtccaagtgattagtaactaccagagaagaaggcaatttggggacaagtacatgcaattttagtactgttttatggggtaaataatgagtttagaaatgttttcactattttaataagaaaaaagaattttaacaaacatggattatttgtagctatccaaaggcaataaaatccaaggcaatctatggaaattagtcccccatttttgcaagacaaacgtgtgaatcaattgtattttccaatgctctgttgagaggaggtatctcagaaacgcaaaatgcattacttcatattagcaatgccattcctactgacaatgtaactttcagtggctctaactcgagtccaaacacacgttttccacaagagtcccatgggaacttgcaatcaccttttcatacccctaagttggtgcagatcaggagcaagcccccctggatgctaaagcaggagatccttctctctccttcttccccaactgtcgtgtctataacttacaaaatcaaaatggagtttttagaaacaggatgcttggactgaagacaggaacgtgggatggggccctgacaggagcaggaatcacatgcaactggaggggtcatcaatgagggccaggagctgtgtgcttcctttcacactgtctatccatcagtaattttcacctggtgctcagtcattttctatctattataaccaaattcccagccagctcagaatgggctggccttgaatatccctgtctttactgaattctttctttcttaactgacgctttgtggttgaacagatgcatcccagatgtgcaaaaaatagttcacattcacagagaataaagtcctggctcattaaagggaagacaacattccgtcctggcttagaataccaagatagcatttcccagagttgacagcgaattggaaaatttaacaaaagccatagaaatacttcctgggtcaccaagaaagtcataacaagagaataccattgatatgccacccagttccaagggcttcccttggcacttagcctcctagccatttcacacatactcacctttcctgactcctagttagacctcgtgttggtacccatatacctttttttctggttcagaaaggctggccccgaaaagcagtagcaaagctctagctctgcgtggtggcaggtgcctgtagtcccagctactcaggaggctgaggcaggagaatcgcttgaacctgggaggcggaggttgcagtgagccgagatcgtgccactgcactccagcctgggtgacagagcaagactccatctcaaaaataaataaataaataataaaaagataaaaaaggaggaaggtgaaatgggtgcatgcctatccttcactaggaaagcgattatagtggtctgggaaaacagaatgatgctgaagttacttgagaaaggaagtaccaccatttgctgtggccgtaatcaagtctgtaaaggctgcaaagggtctgagcatgttcctccaattatcaaaaacccattcacaactcaggaactctcaagaggttcctcccttctctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagttgactaaagaagatagaatgaaaaggaaccattgcacaaagatatgtttttatttgaccaacaggctttattttgattccccaatcttctggaactcagactttctcagcaaacaattgcactgcccactgagagtaaacagcaaacctgccaatatcacaatataccctgagatgaacacgtgtgagggaaagacttcatatgccagacataatcctgatggttcccaaatacacactggttcccagataaagtctggtgactggctaatgcttttcactgtgattaaaagcaaatactttaaaaaatatttaatgattcattattatatttttctgagtgcttaagtctattgtctcattattgtttgtttattcgtagtttgggaaaattttgttgggacaaggtaacaagatagatctcagctacagccagaagtcataatgttcagacacacattaattctgtggacaatatgagaaaatgggagcaacaattaccctataattagggttgtgaactggggaagggcaatgtccaatatcacagagggagggttgaaagaaactagagatttgacagaaagtgatcaagctcacaaacgtatctatcattgcctcattttttaatgttttaggtgaatgaatttgagtttctgtgttgagcaatgacttgaatatttcatctcactcatgtagcccttgtcacaaattatttttcctactttagaatctactggactgctataaaataaaactctaatgcttggaacaacaataacagaaaccaaaattttatgctttgttcttttacaggccccttcaaaccccaggaacaggtgctttaaattaggctgccgaaggccagtggggcctggctttattatactttggtaaataatagtcactgttgtcatcagagttctctacacttccagaaaatgtcactagccacatgtcagcagggttctttgtctaatttctacagctaaggtggcaagaaggttattagaagtaatagcaaatttaaagttttattagcagtaaactgcaaaagctaatggtgatgccaacactagataaaatcattgtcacagttaattctgaactccttatttcaagcttaataataggaaactcaatggaaaggatattacacgccccatatcactcatgagtgcctcaggcctgagtaacttgttattttgctcatgagtgaaataaaatgcagattatactgcctgctatcaggggcattgttttaattgagggtgaatgcatggtgatgaggggggctccgagtaggttctcatttttgtaaatgttatgagaatattcttctcatttgtaactgtgactcagcacatcacctttctattacttgtgggggtgtgtgtgtgcttttagagttacctttgtttcagctccagagaaatgaaagcagctggggagatgggagggtagcatttggtgcttctcaccagcatttctgcaaaagtgcctctccagcattctagcgcctttgtcttcaatccctcagtctacagaggcaaacaatggaatatctgtgttgctctgtttgtctcattccaatcctgtatgccagcacacacacacacacacacacacacacacacacacacacacacacacaaagcccttccactctgatatacactcccggccaggaataaataatacaagatgcactcctctgtgctttacatttactaagaaaataggtgtttccgagaatcaagatcacgtgggattttgtgttctttttctaaagtatgttgctctttttttcaaacaagttgaagtgatttctgatcctatgccacaaatcatccaaatgggctgccttgagagccacgcatgcattcctgctttaaggggagccttccattcacttgacacggactgtctgtaattatgcagggctaacttcaggctgcagtgtgcgtggagacgactattttgaagcaggtcctattccctttgattgaagttgaaatcctaagacttccacagccgagatcatttgtgcctctctgagtttcaatattccctttgaaatatttgtctgatgatacaccgtatggacagagcctcctacagttcagtttctgagcaattatcactccatggcaatttgacttcatgtagcagtggagaaataaaatacttaaggctgctgccagcctgcctaacaaagcttttgcataagttaaagactcagaaaggggtgggaaacagtagttaaacctttgctttatcttttaagtttgtaaaacatataaaatctgagttcaaaatcttagaggttgtgacagacttctccattagcaggtgaaattagcccccaaattataatcttgattgattcaataatgttcaactagtagtggaatgagttttattttgaataatttcctcactcctgtttctctgcatcctatttcagtttgcagtctgtcctttaaatggcatttcctttttgccaaagcaccaagctgtgaatttattgagaaatgggtgtgtttacaataagactatgccattaccaataagtcccattcatatcagaaaaaattaaacattatattcctaaattgtaaacaaacagtcctaaattccagagattattattcccagaaaggcaaagtacagagccaagagaatttgtaaatatgtacaactttacaagattgatatggacaccgatgcatgttgcgctcatctccacttatttcttattcatacacatcattcttatgtttgacaatgaatatggtattgtggcacttgaaatcctttttttattaaaaaacagaaagaatgtcagccagttaaacatgatattaggatttcatcttatttttttgttttgttttgcagcaagagaatttaaaagaaccatcaatcctctctaaaaggtacttttaataaattggcatacctaattttgcatggatgccatgatgtctggcctgcttctatttggagtctcttgggatctatacagatttttaatagtcatgagaacttgtcttgtactgtggattgtagaattgtcttctattatagtcagctatccactctatttaagacagaagtttcttttgctgctttcttggagttgtttgatggtttatgaatacataaaaatctgttggtaattataggttaacgtaattagcaaacattttaaacttaatgttttcctaggaacagtttttgtcactttttcatgattgtttaaatattatatctttaaactctgtaataatttcatctaagcaaaagccttgatctttaaatcatttgatgaaccttaactatccatgatttgtttcaaaactaagtccacacggagacttcactatgccatgtgcctcatctagttattaaatgtgtgatacgcgtgcttcttaatgtgtgcatattagctatttttaaattataattttaccatgaagaaatgaataaaacttccaaaaatgtctgtctcagtggaatgtacactatcgtagggagatacgtatatatatagtatattggttggtgataagtgtcatggagaaaaatcaggcagaaaagataatgtttagggagagcctctctgaaaagatgacatttgcacaaaaggccccaaaggaagtaaggaagcaagccatgcagctagggatgccatgcagctagccatgttctaggcagagggaaaagcaattgtcaaagcattgagacaggggcctccctggaacatgtgaagagtatcagggaagccaatgtggcagaggcagtgggagtaagaaaaagagaactgcagtggatgagatcagagaaatggtgatggtagagaatgtgtgtgtgttgggggggcatccattgagtggcttctactctgagtcagatgaacagctttcaaaggatccttagcagataagtgatgtgatctgccttatgacttagaaaagaaaacctgagctaccctgagaatagaccctcgagagaaaaagggaaggaaatagacgagttaagaagctgttgaaataatgcagatgagagatgaggaaggtttgtattatcagtagagatgggatggagaagttacattctggatatatttagaagctggggtagataggatttgccaacaaattggattaaaaatgtgaaagaatgaaagtcaaggataattccaagtttttaatctgagcaaatggaaggtcagaattgccatttattaaatggagaaaagtttgggagaagcagatttggtggaggcaagtggataaaggtttgaacatttaaggatggggttgagtaagcaattgcatctagaagtctctatgtcagggagacagcttttgcttcaagattttgaggccatgagaagaagagaagaagtccaaaggctgagttcttagacactcattgtttagagttcagggagataaggagaacccagcaagcaagactaagaagaaatgatccgtgaggaaggactggattcaggagagtgctatgtctcagaagccaagtgaagaattaaagaaatgaagcatgacagtaaaacttatacatttatttctaaataaaaataatctattcatcaaaatagcacgacatttaatgtgtcgataaatatatttaaatttaaacaaacaaattctactttgaaatctaaattgagtagtataattgttgattaaaacactcaagagattatattcaaatccctactttatttattttacagtgccatgaacattcaaaagtttgacccaattctcttgagattccaaaaattattttcaaattcttttggtctttttatagtgtaatatgtatgaaatatcatgtttgctctggggtacagtattgtttttaatgctgggcactgtaaaaattctcaaattttagaattcctaagtatctgctttttgtttgttcttggtttatattttctgatgtcaaaggtctcatatttgcatgcctattctaggcatggattgtgggagtctgagctttaaaatagtccacaagaatcattttgtgatttgggctttatctactgcctttaattttaggcatcaattttgaagtcatatcagtagccttaccacttgaagtaccaccaagtaggaggctaattttatctaagaaaagtgtttctacttcctttgtttttgattttggtgaagacatagaggggataggaggataaagtagaaagaagtgatttggcaactatcctattagtttaaatcataattagacctaactgcataattcagaacccaagttgagtctcctagcagctcccttaggggctctggggctgtcccatcacagaagccctccactgaacttcctccccagttgctcccatgggcacgttgccttgtgtcagaagtcagagtatgtcttcttccagcttgagtttctagcttctaaatatttgtagcagactttaagtggcaggataagtggataaatgaggaatatatcacagagactcacaaaactgctcaggcccaactagtgcctatgttatcagctcctccaatctctgtacttttcctttgctagagacatcacacccacaactgcttttcaatgcccttgccacaaggctctgagttccatggggacccatgtcttatacattgttatattcctggtatctgacaccatatcaggcatactaagatacttttaaaataaagcatgagaggcccaaactaccttgtttaaaaaggcagaaaaaaattgtaaagaaggatgacaaggcgtgaatatttttcaagtcacaatcataaaaatttttataaattgttattgatatatagattatatataatctatttatattagattaaatataatctggcaaataaattaatgaatggatctcatatagtttattttaagtagaattcatagtactgaggagaagtaaaatcaccagatacaaaattaacagatgttttagtagcccaaagtgtggagtaggaagtatacgttagtccattctcacactgctataaagatactacccgatactgggtaacttataaaggaaaaaggtttaattgactcgcagttccacatggctgggaaggcctcagttaacttacaatcatgatggaaggtgagggggaagcaaacttgaacttttcacatggcagcaggagagagtgctagcaagagcagggaaaactgccttataaaaccatcagatcttgtgggaacttactcactatcacgagaacagcacgggggaaactctccctcttaatccaaccacttcccaccagggctctccctacaacaatgagggattacaattcaagatgagatttgggtggggacacaaagcctaaccatttaagacatcttagaattctacctacctcagtaatcttgagagacaaatatctgttattttcacctttgaggaaactaagatttcaaagatttagctgacttgcccaaggacgtctacctgagaaatgtttcttactaggaatgtccccaggagatattcggcaatgtttggaaacatttttggttgtcacaaatgggaagaagctggaaaacttttagctggcccaggttaaaattctattagcatgtaagaagaaaagaagatatcaaaaaagaaggagagaacatatcaaagttgcttcataattaatataaagtcagatgctccaggagatgtcaaataatttgcccatgatctgatgatggtcaacttactcaccattaccttgttctttccagtaatgataactcacacttttcttcatagcctaaatgaaaaagaataacataaagcaagactcaacaaactaagggtcttcttgatactaataataaattagaagttcaagttccctatgagattaacaggctcctttagagaaagcacattattaagtacatgtccttctaagtgatcaagatgtaagttttccttgcagtataatgcttttaggcggagaggtaacagactccagagaccggagggagacacaggatgagaaagggaggcaactgttatgatgtgctatacacaaatgtgtgacagtctcaccccatgaaggctcacagctctccagttccttttgatgactgcctgtgtggccaaagtttaaaatagacttagtataagtgagtgctgtgccacaggaggagatggaagaggatgagaaaattacaaagtacaatgtagacagcttagctaggaagatgatgttgacatagatgatagatcaatcgatagatagatagatataaaaatggaaaacaggccctttcctcttaggcactacattctctgggacctttttcaagaccatgtgaggtcagcattactagccccattaacaaatgagagacaaagaatgctaaatatcctgatgtaggcagcaaagcccctacctattccatctggcccagttgcctctataggcttactttgtatcactctctttctcattcattcagctccagccacactggccaccctgctgctcctcaaatgtaccaggcacatttccatggggcctttacactaacagcttcatctgcctgtggtgctcttccctgaagatctacagggttcattgtttttctttaggtgtcttcaaatgtcaccagttcctctctccctcttgatattcctctactccattccctgctttacttctctttaaaacatttctcaccatcatattctacatcacccatctattccaatcctgcccccaacaacaaaataacctgatgtaagagcttgcatgtaggcagtgtattttgcaagtaatgccaaggaacaaaaatgggaaaatgggaagagtgaaaagagaacaaaagcaaagctaatctagcagtgcattatcaagttggtgacaaatgtgggtaactagggctcaatatgattaggggtcctctgaaagtcctgcataacacatgtcagaattgtctaccagagttacaggcttctatctcctattctttaagggtaatcccatggctgtgttaggaaagattcagaatggctgagcgggttcccataagtgttccacacagaggaacgctagggcaaaagttggagtgaggtgttagctggtcacacctgcaatcagctagttgtggtaccaatgtctggaataaaatggtcaaccaagaggttgtgaggtaggatataagaggttcatgaaagagtccagcttttgcaacactgagacttctcccagagccttcaaggcagtgtggccagtactgatttctacaatagactcgataaagaaaagctatttgggaaagggagtccctgctaccaccaggccgtcactgatattaaccatcttttttcctcctccaatgtcattctaagttttccctattcttagtcaccactccagttggtctaaactgctttgtctggagagatggctcaaaccatcatctacatggggttagaaacctttattactacaccacagtcaggtcattgtctttacaatagtccgttttctgttatcatctggacagccccaaggaagctcctggtttctacacctgctcttccatggtaccaccaagcagcaccaccacgaggagcaaccatagctcctcattcaaatcaggctcagttatccccaccaacgtgatgacttccttctgcttttggggccacttgcatgagaagcccaaaatggccaacaatggtcatagttccaagactatgacttattctgtcctctagtgaagtatcctcctgccatggtagaaatcagaactcctaatccatcagagcctagattgtaggaaggagaagcacagacatcactagtaagtatgagtgataaccatggggccaatcttttacttcatggtttctaacccatgtattctagctttggggaggtcacagcaccatatgttggccattaatttggggcatacacacttcctgaggaaagcattccaagcctacatagtgtagtccctaaactggcacctcggccaagcccccaatatatcttcccatcattctttgaggaagccacaccactgtaggtaagacccagtacttttcaccattgtattccaacatgtagattagtacctggcacgttcatcactctgaatatatgaatgaattaatcaaccaattattctctttagattaactgagacattcaaaatcaaaaaacaaagaggttgaaattcattataaactcgtacctcacattattaaagcttgaggaatgatctcttagatacaaacgtaattagcttctatgatgttgaaaaataaaattaggaaaattgaaaaattcacactttcgtaatgtatgtggaattaatctattaatataaaaaccatacttatttggcataccaacaaatcatacacttggcaacataggggtacaaattcacttatttttctttgtcctgaacactaatgaatttcgtgtatgaaaaacttcattaagaaacattgtttaaaaacaaattgtcaaaacccgactctaccagattaaatgtatgttaaaacatttaagatgacatttattgcatcaattttttaaataatgcttgagaaagctgtgaacataacttcatagcccaaaaccttcttctctttccctttgtagcatatttctccgataatgtattttgcctactgctaccaaagtaccagaaaataatgcctaaaagaccaaaatgaagtgtttcagaattaaggagaaagttgtaaatttgtaatgttttagacacatttcagtttagcgcttgatagatcatgtcgggttggttgcgagagggatttcaagggcttgggaaaataaagtcagtgtatgtgtagtttcatttttgagagaatcactttattactgatcacaggacagttgttgagctctgacagctctaagtgctgaaaacattagagaaggtccatttttttgtttttgcccaattatgaactgtaacttggtgagagaagcaatagaatctatttacctaacctaatggtaatgcttcattttaactaaaatgtcaacacatagtggtctctgcacgtatttcaccagcatctaaattccaccatggggttcaaattttttaaatgaaatcttagacccttggtagaaaaagagccaaggatttatatatcaatgtaaaaatggcctatcttaaaatatacttatcacaaatataagaaattcctaaaatttggggttttcttctatggctttctcaaaggtcagaatgcaatgtttctattcaaatgaacaattcaactagttaactaatacgaagccccttttcttatcttctgctaacctctcacctttgaaatcagttgtctaacttcaagtgttgccttcccaattaatgaagttatctacacaattttcaaaatgtgactccatgtctatgagtttgttgttaatattactggaaagacaatataatgtgaaacaatagcaaaaagcaaaaattgaaggcactagcaccttctttgtgggacaggaaaactaacaaaacttggtgatttgtattaactcaggaccacagtaatctcataaaatggctctttcttggattttgcaagatggtttcattatttagtgcaccaatcaaaaagatagccaagtttttaatccaggccaattgaaagcaaacaatcaatgcaattaagaaactaggaaaaaaaggagaaattctgatgtccagcacatatattaaacttaattatatttttcatgataaagtaaatttgctcagtggagtctcaaagtatgttattgttataaattattttaaagttttcaaagataactttcaaaattaaagttataaaagatgactcccattttctcattttcctcctcagtttttaatgagcatacatttctcacttcatccattaagaaatgtttgtggtttaaaagttcatgttgactgcaaaaatggtgatagaagaaagctctgaggatattgctataaagttaataaatcatcttcactcatcaactatcttcaacccgcacaagttataaaggattattttgttagcaccacagggtacacaatttaaatttagagaatcagccctagcagaataagtttgaattctggaagcttctaggtccccttgcctttaaacattatacgcttcagagtccttacattttcaattgacagagaaacagaaaatcattctaacgtttaccgtagcttttccctctaagggcttcttgcaaagaatttgcatgttgcaattatacctcaaattagagatttgagtttccctgcctggtcaattataagacccttggccttaccagagaatgaatacacgctctcaactttgcaaaggtctgagtcaacagcttgttgggctttgaagaacctcagccgtttttgcggctggagctttttctccttttcgtgtttcaggaccactgctggttttcattcatcttcattcagtgggtttcatgtgacattttggggctggaaacataatgtgtcagaagatagctgcagcttcctactgcgttattgtttcctttgtcagaaggtgagtgagcacaaacattttccaattgctctgattttcagacaggtttagatctactgagccatcactgatgcacacgcctataccatttagaaacacttgatatagatttcagaagagatttctaagttcagttctatacaaataaatgtactatcatttatcctttttccagaagaggcagagatttcatatcctctccttggtttaccccgatcagtataaaaggaatagatacggtgcttcaaaaacacttctcatttgggttcaaaaacagcagctcacctttctgctggaagcaaaacattatcatgatcaacagaatctgtctgttgggattcagttctgcaatcctttcatggatcaaattcccatcagaatcagaattaagtcctaagtgaaaacttaaattacattataatactcagcctcataagttccaccaaggctttgccaaaggcattgaatgatttatgataaacttcagaacctcagtcccctcttcccagggtgtcttcaattaattctttgaagaactttactcttgattccttgttgaactgaagtaataaggggtttaaggcctttatatttttcctcgaactttctcttcttaacttagaatatctgcaagtgaaatataattgattggatctttctaaatctgtcttttataaaattatggttaaatattatcttattcctgcagaatttatatgacttttaagtataaatctctatgtcatcttagttataaaaatcatatcattagaaattgccaaaatgcattacacttcagcctgaagagtaaggttcctttcagttagaaaatagctccccaggaaattccatgttggtctgtatttgattccccagccgcttgggatgcaaatgcatgccattgactgtaataagaattggatgtatgtctataggtagactgtaaaattttaaagtttgatttgtctcctcatatggagaaactgaatcctaggaaaatttagagacatttcctagatcacacatttcattaaggttagtgtgggttctctttctattatggggtgtggcatcagaaaaatgtggttttaaacactgggtcaactagtaatatgccttatataagtcatggcatagtctacttagtgatgccatgaataacccactgagcttcatattcttaactagcatattcttaacttatctatattctaagatagctgagaagatgaaaaaatatgtatataaaaattctggccccaacacgcattaaatgatggtaaagattataattgttgatctttttatgtaactaacctcctaaaattatctttctgcccttttctccctgattcattcttcacacagcttatggattaactatctatagcacaggtcttagtatgattctctttactttaaatattctcaatggcttcctatcatcaatgaaattatcttaaaatttctcaccctaaattgcaaagccctgcgtatcaggctgcagcccacctttccaaaaatcattttaactgtttttctgtaattacactattttcatgtctagctaaattggtttacattccacagacaattctccaaatttctaaaaccaaaattccatctcccctataagcgctttatttattcttccaaccagatgcaacatttcccacagaagtggggaagagaaaggaaaaagcacctactgaatatattttctgtgcagagttctttcttctgtgctgggcactttaaatttgttatttcattagtgcttctcttatgacatgttatcttttgttataacaaaagacatgtttgttgttgtccattaaagctgtccattaagggcagaaataatgtcttaatctctagcatagaatatttacaagtagaaggacttagggggaaaatgcaaactgaacaccttaaattattatcaataaaagcactagccagaatgaggagttgaggggcatttgaagcaacttggaaaaccatggcagcttatttggggtagaaaggccctcttttatccatcataaatcatcatcagatttatactttgttagcaaaagggggctgaagtacaacatgtcatatagtgtgttgcaattgtaacagggcctcactcttctttcttcttcccaaggcctaatcagttacataaaaaaagaaagaagagaggagacgagagaagaaaagagaagacaagagaagagaagagaagagaagagaagagaagagaaaagaaaggaaaagaaaagaaaacaaaagaaaggaaattaccacgaaaccagtcctggaaaatgtaaaatgttacttgcatcatcatgtgaaaaagctcaaaagatggaaaaatattttctaagtacatttatttggacataacataagtatcttccaacatattttagcgatggaagatgtggtgaattgaaaagatgagttcagctctacatatgctttatggtcacaagttgccacttttaaaacatttatatactcttatgcatatcatataactgaacatgaatgttagcatctaagtatatgtatctgatgaaaatgccagagttataaaatcttttttatgtttttttaatcacaaaaatatcaaaatgcaccttggttttagggaataattttctatcactggtcctgagaacctctaaaattatggaacaatcgttccagactctcaataccattaagttcaatgaactataaactccagggcaaagaacacagcttttttgatcaacaatgtatatttaacgtccaagcttaatgactgaagaaagtaaactccctaaaaacataagtttttttttaatgaatcaaaagaaaaggaaaaagaaaaagatatttagaaaggacccatagtttgtcatctgaatgcagcagacatttaaaatggactctatcttttcaagaatatgaaatctactgacccctttcaaggggttcccccacctttcattgcctccctcagcagaggggttgctggatgccattactcagggaaacagttttgattccttcctgatcgcctattatctctcttgttttattgaaccagggtctctctgcaccctggcagaagctggcaattcatcaggataccatttagggaatcactgtgatgcttagtttacagtccacaaggcagctactgggagaatctggatcaatgtgttttatgcctctgaaatttgggcagcaaagaaagagtgcttcagttataaacatgcaatgtccatagttctcatcatccttctgaacaagcagaagctccccttttctgaacccaaatggagcaatccaattacaaagtcattaaatcccgttataaggtggttcataggagttcctgtttccagcaaaagccttttctgtgttcatccaacatatattctggcctcttgcactcagtttacaaggtttctaattaagctccagagaggatgatatagttcactgaactgagtcactatgctacaactgggaaagaagaggcattcctattttatcagaaaaataaacactttagtttcatttcctctgccacacatgttatctctttgtgctgtcacaacattttttataggtttttatttcaaaggattaccttgagattactgtcaacgcaagccagagagacatctccatacagaatataggggtaatattttttctcctaaaacatcctgctacagacaatataatatcatataatatcaccgaaataatctcccctattgagagcaaagagacagttttcaatagtactttggtacaaaatttgaggaaaataaaatgtttatcagtgacaaaaatacaatttaccagcttgatttttaagtcaaaaatttaaccttttaaacgatttcagaagctccgctaatttctactgttccttgtaacatctgtaggcaaaatacaacatgctgggtcataattcatagcttggcaagaaaatgttgcttaaaaacataaaggtccttttctttttatgcagaggaaaacattttagttattattcaactcaagtaaatgctcataaccatggaattaaatatttctgaagggttcattcctgagctttcttctgggttgaattaggctttctcagaactatacttcatgtcacccacatgtcttaagaactggtgccttctgctcagctgtgcatttttttgcagacatgccggatatctacgcagtaagtgctctgaaacttcaaagagacacagagcattctgtgctttctcttcccaccattccatgtaaacaccatgaataaccagaccattcttatgccaaaaggccctgatggcttgactttttggtccgttaattgttcacaatcactccttgcctgtattgtgcttggtaggaccacctttctgcagccaaaatccagccacttaccactgcatatacttcctacagcagaatagatactgaccaaagcctagtagaaacctgcatggcatcctgtctcttaatacttaatgctaccatgccctcagagtattcttattcagaatctaaacaagcatgtattcagaggctacaatgtatcaggcattggtggtgttagcagtcatagttcagtgaatgggaagaaagataaaaatccatgcctcccagtgactttaagtcctggtagggacaaatacagaagataagtaaataaacaagataactgtagatagtaataggctctgtaggcaataaacctcaggataatgtgatagagaatgacttggggattggtaatacccagatggggagctggaacaccgtccagggcagatggcatttgaactgaaacctgaaggaaaaaagaatctggacagcctcaacaccagatcaaacagtttttgaaacatagaaaacaagaacaaagcccccagtgggtgagaggaactgaagaagcctagtaggatggaagtataatgatactcatacactggagaatattgctaagcgcaaacaattctaagcttgtgaaagttccttgtgattattctatatttctttgaatcatattgatgaaaaattctttgtaataattcccatccaaatgtgacttcttgggtgcaaacataattttcacaacttatttaaaagcctatttaactttgcctatagcatgcttcacagaaatagtaacatccatcttacaggactttcatgaagactactatgtacggcagtcctcacttttttcctgctcaaaatcctgtctccctttccttttaaaagaacacagactttgttcgtgaccataatgtgttctccttaaaactacatgcatgcatgcattcctacacatatacccacaacctcaccactgcttgcagctagtgagttggcaagtatggcacacatagcacagagatactaatgagatgtgaatagaagatagatcttaaactcacgcattgtatttccctttactgttccctgtctggaaaatgaatgtgatgctaaaagaaaggcagccttctgtgaccctgaggtagctatgagaagttgcatatttggaatagttgaatggacagcttacaggagctgtgttctacatagatacatagttgtatgtagccaaatgcagaattatatgtaaagtgccacaaaacaaatgtaaggtaaatagtagtgtaaggccttcattatcatttatattactggtgtgttttaatgaagcattgaatttatttacagaaaaggatgctaagctgagatattttaaagtcaagctatataagaatttgaagggatatttaatataatatctgcttttccaccagccatcaatctcagcaaactcacacaggaccagaaaaccaaacactgcatgttctcactcataagtgggagttgaacaatgagaacacatggacacagggaagggaacatcacacagtggggactgttgcagggtgtgggggcaaggggagggaaagcattaggacaaatatctaatgcatgtggggcttaaaacctagatgacatgttcataggtgaagcaaaccactatggcacaagtatacctatgtaacaaacctgcacgttctgcatatgtatcccagaacttaaagtaaaatttaaaaaacaaataaataaaaataaaataaattaaaaaaaaatctttttaaaaagtaacacacctagtagctatttacttccataactattgtattttcttgccgtgccaaaatatctggcattgtaagaatgcacaattaaatatcattcatttactgacctagtatattgccagcaaagaacatgaagacatattctgctattgtttttctttctaccactgatggtggcaccaggcatttctcctatattccaaataaataatagaaaatacctttgcagccatatgagcgtttggaaattatcctagcaatctggcaagagcaaggaggttgacctggcctgcaatgatacgaacttaggggctccttgtggcctaaacttgtaccaggacaattctgagatcaacgttaccactgtcaatgagatagaagtcttctacacaaacaaatgtctgctgctcaaaggcctagtcagtgtacaccatctcccataagaaacttcccacaggaatctttagtaaacaactaaacagcactatccacaataagcagttgttatttattaatgacctattatttcaccaaacttatagtattaaaattgtaattagtagttgctatccattaagtacctatgagcctagcaccatacaatacagtatacattgtccttaatcttcatattacttaataatatgattaataatccccaaaatatgtaaaattaattgaattagcatacataggaaaaattcaaatgcattctaaaatttctttattaaaataagctagataactatgtggtcaaaatgctgtcatctattacctacgttgacttattgatgaatgtgtgtagatactttgtcactgggtcacttatgtcttgctgcttatccatgtctgcagaattttgcagagttcttccaggaaccgccaggctttctcaggataagatatatcagatgcattcagtgtgatcagacacattggggtacatttcacccagaggtgtacctgctgtttgtaatgctgctcaggatttgtgcctacaaacatgggaattctgataaattctatcttacacaattcccataaaaatatatgttgtgggattatggttacacttatacttttcaggtatattcctaataggagagacccatcattttgactaggcatctacaaaaacttaactctacccctgtcccttacaatttttcatgtttaatgtttagaagagttttcaacagaccatcttctagctccagatatttcaccttttctctgccactacccaagtatttttctatttctttaattttttaaattaaactttttttaagtaaatcatagatccacatgcaattgtaagaaataatatagagagacccatttcttccatatggcaacgtctggcaaaactattctataacatcgcaaccaggatattgatgttgatacagtcaagattcaaagtaccaccatcaccacaaagaccccttatggtgtccttcttccctcctgccagacccacttccctcctgcccccacctcctccttaaccctggcaaccaccaacatgttctctatttctatgtttttattttttcaaagattttatataaatgaaatcatacaatgtgcaacttttggtgactgcctattttcagtcacctgaattttctggagcttcatccaggctgctgtgtatatgaataatttgttcctttttattactgagtagtattccatggtatgaaaataccgcccaactatttttattgccaaactctgtagttcacattcatatcacaacatgacctccaccccagcaccttcatgacatgatgccaagtaagtcaacttagtgggcaaaaggaatgttccttacaggtattcaaattcagtttagcaatgcccgaattatatttggaagtttttaaacattccaaacttcatctccaactcaactttctcttagtaaaatgcaaaagttaactaatttttaaaagaaagaaaagaaaaagaaaaaattatgttgccactccaatcctgcctgatatgaagggaagtatggcagaggggaatacagcgtggaaagagacagtggtctcacacaattatggttaaaatattttacacttataaattatgtagcagtctgtgctcagatgaatacatggctagggcctcttttaggaatcttgaaagaggtcagaggaagcatgggacctggagcatagggctctttagaataaacctgcttcaactttcaaattgcctatatgttaacaggatctctcttgttaactggagaagctgccatgcttatctcaccaggcacaaaaatgcttccagccaagtcttcacaattgccctgaacaggtaaaatgaaagatacccacacttgaggctgatgccccagaatacaaattattaatgggtacaagacctattaatgacttgagtctgtagagagcacccagaaaaagaaagagctcttgatgtctcacataaaaagacgttttaattattgaacatttagtggcaggggtgagggaaggggagtgtgggagggcccaggtggaaagcagaaattttcctctacgactctctagcaacagcaactgccaatgacaacagcagctatgtgttgaacatttgttctgtgctagtactgtcaattcatttaagtcataaaacaattctttgaggcaagtactttattatgtccatgtttaaaagtcagacttattaaggtataatttatttatcctttttactgcaagcctcgaaatcaggtagtgtaattttgctaggtttgtaattctttctcaaaattattggtcagtcttggcctttagcttttccatataaaatgttatatcatcttatgagttttactaaaaagccttctgaaattttgactattgtcgcattgaatctttgatgaatttgggaataagtgatatcctaaaaatattgaatcttcttaaccatgaatatagtatatgtctccatttatttgggtctttaatttgtctcagcaacattttgacatttttatcaaacaaatcttacagatacattgttagatgtatatctaaacctctcatgactttgataatatttaaatgatatctccaattttcaattgtttactgctaacaattgatttttatattgatttgtttactgtgaccttgctaacctcattttattagtcctagtagatatttttgtaaattccttgagattttctatagaaagaattatcctgtttgtgaatagagacacattcatttatttatttttgatctgtatgtcatttatttatttctcttgttataatttacttggtataacctccagtgcaatgttggaaagaagtagtgagagtaaacacccttaccttatgcctgaccttgggaggaaggtattcattctgtcttttactattaaatctaatattagctgtggactttttgtagatatcctacatcagattgagggagtttcctactattcctagtttgctgagagttttatagttgaaaactattttcaatagttgcataattcattgttaactagaatatggtctatgttggtgagtgtttcatgtgtacataagaattatgtgtttcctgcaactgttaggtggagtgctttctaaatgttaagtagattcatattatcaagtaggttagtgttattagaatctgttatccaggtcctctatattcttactaaaattttgtctactgattccatcagtcaattagatagcaaagttaaaatatccaaccataattgggatatatctatttctcttttatgttttatcagatttttgctttccatattttgaagcactgttatgaagtgcatacaaatttacaaattattattttttcttggtgaattcgcttctttatgttatatgtctctttacttctgaaattattgattagctattacaatatatttttcactctttttctttcaacccatctatgttgttatattttaaggttttgttttatagacagcatatgatgtatttctgctttttgattctatcttaatatctatggtttttaaccctttattatattgctatttgttttatttttcctttgtctaatctgttctttttagtttttctctgttttcttctgctgtattttattttatgactccatcttattcccactttggtttattaggtaaacatctttattttttcaatttttttaatgattactgtaccgtctaaattatatttttaaaatttatccagtctatcttcaaatgatatttctccactttagataccattagaaaccctgaaacagtatacttttatttcatccagtccattctttatgaagttgctgtaatgcatttcatatctatataagtgataaaccccatattgaatgttgatattttttcttaagtttttcatttttttattaaaacagttcaaaattaaatcaaattcttttgtatttatcttcatttttaccacttttagaactctgtatgtcttatgcagatcaaaagtttcacctagtattatactcttgcttgaagaacttactttgacaatgcttatagtacaggtctacaggcaatgagtcctctcagatttgttttgtttattttttgtctttatttttataaagatatttttactggatagcaaattctgaattggcaggtttttcccctccaagtactttaaagttgtaactccattgtattttaatttgcatgatttctgcaaaaatatttgctattgttcttagttttgttaccttatgtataatgtgttttgttgtttttccttttgactgccataacattttctctttgttttggtttgcagtagtgtaagtgtaatgtgactaggtatattctattttatctatctatctatctatctatctatctatctatcatcaactgatcaattgattgatctatacttatactgcttgggatcacctgggcttctggaattgaaaatttgttgactttcattattttagaaaattcttacctagtctcttcaaaatttattctgccaagtttctctctcttcttgtctaggactccaattacacacatattagactatttgacattgcttcatagcagctggatgcaccattatgttttcttctctttatgtttccattgatatatcttctagtcaactgagtctattctctgctctgtccagtttgctcatacacccactgaaggaattttttatttgtgacattttatttttttattttgaccctttgcacatgacacatatttcatatagttttcatctctgctgaaattactcatttgcttacatatgtataacatctatccacgaaatcctttaaaatattaaacatagtttatttaacgtttctatctgataatgatgtctggatcatctataaatctggttttgctggctactttataccttgacagtaggttgcttctccctcaatatctctttctctctctctctctctctccccacccctgaccaatgagtatgtgtgtatcttgtaatttttggtttattgctgaacattgtgtttaaaataatatagactgaggtaaacagtctttatcctggaaaacaggcatgccttttattttctcatgccattcatatgcatgtcatgttgggaaggtttagtcagtctaatcagtttttgagcttggtttgtgttttgttattgccatggtaaccttcattccagcaataacttcacattccactagcatttcactgtcgataccttgtgcttaattggattttgtcataggaggattttcccctgtgttcttgctctattctcaatttttaacagtccttgtatgcttatgccatttaggagtatctctttatactattgttctgtcttaattattattttgcacattgttcaaggtgtgatgggtaaagtgggtagttttctattatcttgacccagcctcacacttacgtaagtcctgggtgtctagaccttgagaatggagctctctcagtgttcctgcccatcctcatggtagccaaatgtttcccttatttctgtaggaaggtgggggagctgggtgggagagaatactgttatttccccctgtgcattgtatcatctcaaaatcctgggtcctagcagtgttttttcctctctctcaaggaatatagattttgttttcattcctcttttggttccaatttacccctgcctatttctattggcaggggttttcttagcacttctgcagtagtacactgctattgcttattactcagtacaaaccttctggttggaacaggcagcttttgcttctattccttcctcctttccttttcctgggactggaagtagttgagtttttaactcctcctccagaagcaaactactttgcttttaccttctcccacaggcagtagttctttgccagggtgctaggagaagaaggagttacccaccccttttctgggatcagaaaaagggagacaaccagtattcatttgagagaaatatgaagatgcaccattgagggtgttcacttagttttcctccccttccctgaatactttctgtgggcacaagtagggcctgtaaatttaaaaaatacttagaaagtacagacttcacacatatctgaagtcctggggattctactctatcatattaactttacacttggccttttaaaacgtgttaaaaattttggctattttctccttactggctgtaattgacagtcacctctttctttcataatcttccaaaggtgaaatggtttatttgactaatctctttttggagggagtttctcagcctttgaaaataagattctgtgattagaagccttgtctctttattttttatttttatttttttttgagacggagtctcactctgtcacccagtctggaatgcagtggcacgatctcggctcactgcaagctccgccttccaggttcatgccattctcctgcctcagcctcccaagtagctgggactacaggtgcccgccaccacgcccagctacttttttgtatttttagtagaggcagggtttcaccgtgttagccaggatggtcccgatctcctgacctcgtgatctgcctgccttggcctctcaaagcgctgggaatacaggcgtgagccactgcgcccagccgtctctttaaaagagtaatgttttcacagattttgttgttatttttgttggtagagtaaaatgacattctcttgcagctttctacatttttagcgaaaagggagacaaccagtatcattttatatgagaaatatgagacttggagaggccaagtaacttgccgtgtatcgtaatctattaaatgttaaggccaacatttaagctcagatttttctgaaataaaagcctattgtcttaaacatcacactgcaatatatcttgtgtaatcttctcatcaaaagtacgtatttgaggtgtctaattaattctagtcagacccaactgttttcctttttattccaaatgagcactggaagcaatgttaaaactattcaacgagtcaatacattttctatcctaagtgcatctagagtacaagattttttttcttcttcaggtgagtatgcctagaaaatctaagcccttctctgatacctcagccattttggaaagtaaatgctcagcacttttgccattattaaataggcttgggtaactctaaaaatttctactagcgctgccttgtaaaaatgcacaggcaagcccaatgaggacatcatgtgatcacaggagcttgagcttaaaaagagaggacagcttcagggaagaagaattctgcatcaaattggggaaggcaatggagaggcaactcggaacagatggcacaacagaaagtagcttagtaggaactgatattgttaccagagaaagtatcaaaatcaaaggcagaggcaaagatagaagctagagcacagagaatggtcaagaaaggaggacagaattaggcttttgaaagaggtggaaaagtggtttggaagagatctacaaatgtaaaatatatccttctagtcacctgcagaagccatcctggtagttaggaacctgtgagagtctgatatgcagccagatggccctcacaccttggccagacatgtgtttatacagtaaattctatctcataaaccactttctcatgttatcttatttgaaattcatggcaatcctatgtagcagggacagaagatattgttagttccatttaccagatgaaaaccctgaaacagaatgttcataattcatcagattttccaaccatacctgcactcatagatcatgacataaacaacaatgctattttttcatcagtctgatcatgcatatttatgtgtgtatatttacttccaaggtgtctacagagttgcacacactctctgaatgttgctaagatatataaatgtggttacttttaaaaatcacaagaaatccattaatgattcattccatttaacaaattacaacatgataaaagggaagaaatttaaaaggaagaattctctccaaagttcaagcaacaaattttcatgtgatgttgggaaaagcaaaatgttttacagcttttagaggcgtaaatcaaaaccttcccactaacacttacaaccattttgaggttttattaaagaaaaaaattatctgaaaattcattacttggatgataaataggactagaaagaaagaggaaaggcctgcatgtggtaagtggaaggcattgatgaatatttggaacattcttttcttaagcccctctataaactgttttcctacatcatctttaaactgcacagatgggttcatgaatctggctccctcactatagcaggacattcttacaggcagggtctggacggattcactttttatatcctaagtgcccagcagagttcctaaatgcagtaaatgttcactaatatttggtggataaaaaatggtgccatcacaaaacacacatatacacacaagtacatatactcacataatagtagcacccataccattccataaatgtatacacttttatatatacctaatccatatgtatgtatatgcacacatattttcatctatataatgggctatatatcattataaataatacagaatcatgtaggtgttgttgctatgtgagtatgtgtatactcatataaaagtatgtttcatgcacttgtgtgtatatgtatacatatatgtatatagtcattttatctttgaatttttcacattatattttaatctcaaataagctttagtgaaagtgagttataacaatgagaataactgattttagtcttgactaatgagaatctcaattaaaaatgtaagtctgaagcatagcatgtcaaatatacatatgtttatataatataaattattttggaggtccccgatacttttcattacctgatcacaattacaggtaattgaaagttattagaaactaagcataaagctgtgcactcccgacaccacaagacctccaacccactagtcagctaaaaccactttctgatatactctgcacaatgaccctggtggctgtcagctctttcctgctttcctgcttccctggaacctgacagggccccagtgatgatttacctatgtcatgttatgtagtccacagcttgactgaggtcttgttctgattcacagcggagtgttgaacaaagtctgtctggaataaactgaatgcattcaggaaaatttccttctcgttcattcatttatttcctcattctcaaacattgagcatctgcaatgttacagatactgcattaaacactcgggtcacaaaagtgaatgaggcacagtccctgtctaactgctgctgaggtttccacagtgacattttcttaaaccccaacttatacagggtgttttcagagtgggattgtacatgttccaaacccaagtgattttgtttaataattttgaccatcaaaaatccagtttgaaaaatgaaccagaatacaaatatacaacatttaatgacagagaaaaaataaaggcatacagttttttaaagaaatatttcatcctttgaagaatactgagaaatctgagttcaaaggtgatgtgagcatgcttcaatcatgactatacacaacagaatctgtactcagctcagtattggctagagaagttctctttccctcatttaagccaagaccagaactccaaggctgaggcttgacataggtgtactgtaaatgaagtgttaatgagatggaaattctccaagttgcttttgagtctcactctatatcagtgtagacctgcctaaaatatgtaagagctgagaatccttttgaaatgattccaaactcttgagtctgaaaaccgagctgggaattcctttgtaacagttttgtgggttattttggcactttggtttataatcctagctggaccccatctgaagttctaaagcccataaaataagaatgaatggacaatgtaaataagccaaatttgagaaacttcagaccctgcttggctgaatgtttctgttaatctaccttgtctgtgctggtagaactgccattttgctataactcctttgtaaataagaaacttttcttctcatcaggcaggggatctttctcttcaaaggctgtgatgtattatactatattgaaattaaattgtttggatatgttttgctgaatactgataaaactatgatataaagcgtattatccttaatcaaaggttacttttatttgcagattttaaaggcaacaaaaatttttatttgacaggttctaatagttctagtttggcatacctgcacatttttattgtatcctgggaacaggcataaatcaactgatttcccacagacaaataaaagtggtggagtaatatagttcctggaatttaacacttcatggtcaggaggtcacatatgctaagttgcttatttacacgcctcttaaagtttaagtctgtgggcaagagacatgaagcaatgtgacttactatatcaatgaagaatgtattgttctttttcttcgggtagataaaattaacagtgttggaacagcagatcacacaagaatgtcatcagaaacatcagccattttttcaaatgtgcttgcttgatgattctctttgttattacaatcatcagttttaaacaatgagatttattaaacatttttttaagtggggaagagagagttagtgtgtaccaatcattgacatattagctggcatctcgaagcctaaacttgcagttaggccaatgtagccagaatggaggtgatgcagcaacccaggtgcctcctccggccctcacttttgctgccaaaactgatcttacagcccacatgttacagatggtgactgtaaactggagagatagccatttgacccacatttaactatgatacaagataagcgatagttattttcacagctttccatataaaggattttgatgagaacaaagttatatacaaacaaagttcatttacgcaacacaattgtattgagatcccagtatgtaactagtactaaacacttcttatacattattcccttttcacatgctcacccatttaaaatttcacagcattcttcagatcagtatattaaggcttagaaaagttttgacttgctaaagacacatagttagaaatcaaatgagtcaagatttgaatccatatctccctgctcagcatctacacttttcttcgctggagagtacattggaagcctaagctgatcacattccattaaacctcaagtcattttgagcccaaggcttcagtttcttcctttagaaatatatctcccttcaaatatacctggaatttacaggtgaaacactggcaaattaataaaggaaattacatcagtgccctaagaaaggcaggccaagagtgctggtaggaaccatagaagcaagaaaacccctgcagctttatcagagtccacatgcagttacttattgcagcatttaaagccttaaacccttgtcccttacctggtggcctcactggatccagcaacaaggaaggaggctgggcatggtggctcacgcctacaatcccagcactttgggaggccgaggtaggcggatcatctgaggtcaggagttcaagaccagcctggccaacatggtgaaactccatctctactaaaaatacaaaaattagctgggcatggtggcacatggctgtaattccagctacttgggaggctgaggcaggagaatcacttgaacccgggtggcacaggttgcagtgagctgcgatcacaccatggcactccagactgggcaataaaatgagattccatctcaaaaaaacagcaacaaaaaaaagccagcatggtacgcctgtaatcccagcactttgggaggcctaggcaggcggatcacctgaggtcagcagttcgagaccagcctggccaacatggcgaaaccctgtctctactaatgatacaaaaatcagccgagcatggtggtggcacgtgcccgtcatcccagctactgggttgggaggctgaggtaggagaatcgcttgaacccaggaggcagaggttgcagtgagccgagatcacgccaaggaaggaggtagaaggaagggttttcttccttccatattaaggaggccaactgcattgccaggactctcccggaggcaaactgaaaaatgaagctctttctgtttttctatgcaaatcgcaatgctgaactttctgagacctggcataatgcagtcacatgtcttgtttttgcattcagaatattgtcttttcatagtctttcagaatatgttaaggaggtttcactatatatcacaaatcatggtttaaatttcaaagcattagataaaaatgaccttacactgcatttgtagatgtcactctcaagccatcccaatgtagtttccatgggaactaatgtacatcaaagaagaaagagagagaaagagagactgtaagatcaaatttttagttcctgcctcctctttttctgggaaaaccaaaatgagccccatgttaaatgctgttgaaattagatactgaatcttatcttctatgtgaatgcagctttttgtttttttcctcctaagaaggagtactacctatatggtcatgcacaatttttccatagagtccatccatataatttataagttgtatttacagcctcagaaggcacatgtgcttatttaggaggagagtcaacatcatccattattactttgttttcaagttgctttcagaattattattattacacagatttacaacttgttgagaatccactctatggcaaccatgagtgaaagtggttcgtgaatgaaagtttatagtcacgtaagaacacattcctagattgtcctctgttggtgtagtgtctttcatagtcatatgccagacagtgtaacatgagtagctgtcattagcttcccatccaaaaagaacagttaccaaacagtattgttaaaaagagcatgttacagctattattctttttttcttttttttgagacagagtcttgctctgtcgcccaggctacagtgcagtggtgccacctcggctcactgcaagctccgcctcccgggttcaagcgattctcctgcctcagcctcctgagtagctgggactacagtcacgtgccaccacgcctggctaatgttttgtatttttagtagaaatggggtttcacagaattagtcaggatgctctcaatctcctgaccttatgatccacccacctcagccttccaaagtgctgggattacaggagtgagccaccgcgcccagcacagctattattcttaaatccaatgccacatatcaaggccaactttatctacctctgtctcataggactcacctgggttataaaataaattcaatactttaatcggggggtggttggagagagacaatgatatattatattctcaattataattgagaatggtgatataaaatgtatttgtagcctgtagataattaactagaaaaacaggtgatcatgtggtttaaaataacaattaatttaagaacttaaaataaatgtttttaaaaagatatataatagtattatatgtcttaataattatatttattaaatataataaatattactattatactatatttacaatagtatatactattatatttatatttataaatatgttatataatagttatatttatattatatattatattacataataatatataaatataaatataataactatattataaatataatagttataaagacaatatgacaaataaatattaaccatttaatttatatcagtcactaccctaaggattgttcttttatctaatacattttattctaataactctgttaattaggaattcatgttcccatctaacagattaagacattgaaggacaagaaggtcaaataaagggctgaaaaaaatctcgtaacttctaagtgaaccaggcagtttccaaaacctgcctcttagctattatgctataaatatttgagaaaagtatttacattgacaaataactatgaagtttttagaacttatgaagatcatggtgaagaaaaaactatttgtaacattaattatcaaattgtttattcctttctgaaatcatttattcaatatcatttatttgcagataataggtaccaggcattgagaaattcagaatgaataagaaaatggaataaacaaagggttataaaaaaatctaggatgggttattcattttaaaagagaatggagcttaggtaaaaaaaagcaaaaatatacacaaggccttgaacattctaacataatgagcaagtcataccctgccagatccatgagagtggatgacaggatgtgctggaaaggaacatgggaagtacctaaaatgaaaaggacctgaaatgtaattctaaagatttcgtctaaaagaaatggcaagttggcagataatttttaaattcaagtgtaaataatctgataagtattttagaaagctgactggatggtataaagagggtggattagagaaggaaaatatgggtggcagggagatctatgagggttttgtgatgggttgaatggtgtcctcccaggagatatgttgaagccctatttttggtacctgtgaatatgacttcatttggaaataggatctttgcagatgaaatctagttaagatgggttcattaaggtgggccctaattcaatatgactgttttccttataaaaaaaggaaaagacggagaaacagggagaagaatgccacataacaatgaaggtagagaatggggttacacagctacagaccagagaacatgaaggactgtcaccaacaccactgctaagagaagggcacagaacagattctcccgcagagcctttagaggaagcaagaccctgtcaacagcttttctgagttctagccttcagaactgtgagagaataaatttcagcttatggtactttttatatgacagcccaaggaaactaacacaagtattggtggaacacttcttcaacaaatagcacttgaattaaggcagcggcactaaaaatggagaggaggaggtatgtggtagaccagggatatatttgctaaaggacaaacgaagtaatgagacttagaaacagaatgatggagccacaaagaatgcctgaaatggtaataggatacatgcttgaatgttgatgggccccatttccacaagcctccaaatctgcttctagatcccattcgagcaagggaggatttgttaagaagaaaggccttttgagagcaccagtccctccaccagccagtctagtcctaagagctctgaaggccaaccttggaagtggtttaggagggaaaatgtaggacccaggatttcagttgccaagccggagagcaggggacccaggaaagaatattggcattcacttgatttttccatcttctgatataaccttcaaatgttaatagtgtgtcgaagaatttattggaagtgagaaacaagaaaacagtgagtctaacctagtcattctagaattgggaggtaatagaaaagagagaaatgggaaagttgctcaaatgcaagtccagtgaatcagagagaaaaggctcaaagcagcagaacaaagcttcaataaagagatattgtgacttggagagatggccttttgtcctttgttctattaccggtcagagaatggggagcacacccaagcctgagacaacagctctgctaagtgcccttgagagggcacggtggggtcagcaccaaagccagaccactaaagagaaaaagagagaaagacaggattgcagaggagaaatgagaatggcagaaaaaataattttttaagccaaaaggaatcagagaagagcagaagtgcctctaggataaagcgtagcaggcagttagggaaaaagggctgttaattaccttgaagctctgactacattagaaagcctcgcaagacagtcgttgcttgcacgggcaggtagagaacttttcctgtccattgttcttctgaattataaatcactgacctctttatgatttctaaagggaaaatgacttcaagcttcttagagttcccctaaggcattctctatattcaatataatatgggaagccctgggtttgtctttgtatgtttcatctgcagtgacctgaaatcttcataaccctcttcctttctccacttatcaactaaggggtggttggcaataaggatgggtgggagagaaaaaaaaacagaatttgaggaggagagcatttaaaccctcagactgtgtgttctgtgacatcaaagactggcaacattctaaaggtaaatgtaactatgcatccctttgggattttcagatatcttgtacaatctattttattcctctaaacatggagactataaagctgtgtggaaatcaatagtttaattcattcattcaacaaacaggtggtgagtgctcatcataacaaccacatctaatagctaacatgttgaatgattatcacacatcaactactatgcgaagtgcttttcatggtttatgtcatttaagtatcacaaataatactatgagataggtgctcttgttatgtccacttgacagatgaagaaactgaggcccaagtcccagtcctaagatgaggcagagctatgttagaattcaggtaatattactcaggaggccatgtattaaacctctttataacatatccctgtatcatatctgcattaggcatagaagactcaagggttatagggtttcagagaagggaagggctgaagggagttaattaggacaggctttaggcaaaaggtgatacatgatgttagctttgaagaagaggcagatttgagtcagcagagcgtgaaatcaaaggctcccaggtaaggaatgggaaagcacgtgagtgtagtccaaagtcaacataagacaaaaggcattgtagataatgaggggacaatttcgaccagaatggtgaccctatgagcagtaaaataagtccgagaagattgagttagccattggagagaagtgtctgacatgttggtgttggaaaatagaaaatcttggtggttttcttagtctaagcagtgttgaaggtaacagcagtggtacacaggatgaattacactaatagaaagcctggcacccaaggatttcagctagggtttgtagaaagatagaattatatgagatgtgttctaaagcaaaagtgataggacttgttctctgtgacatattgaaataaagtatatgaactgattataccaacaataactaactttattgagcatatactgtgtcctatagtggtttacatgtaatcatagattaattctcataatagcaccacgatttagaattaaaggaaggcccgttctaatcctaggatttctttcgttatctattgaagacaatgaaaacagtaattctttaaataatgttgtgttatgggggtattatgataccattgacaggagtgaaatagtttggaagtttaggagcagaaaaggacaattttgactgaaggcaagtaaaccaatcaggggcagtgtaactcattaggtcgtcataataataactattgttattattatttattttgattcgactatgaatcaagatgtcctgcagataccaaaatcagtggctgctcaagtccctgatataaagtagcctgccttgactacccttctttttataattataattattattacagctaattactgcatgcttattatgtaccaatgttctaaacatttcacatgccatagctcagttaagatagtaataattatagtgttcactattacaataataagagtttatatttacagtgctgatagtgttccaggcactgatatgtttttaaatagattaactcatttaatcatcacaaaacccacatgaagtagatactaatattctaccttcactttacagatgaggacactctggtccagagaatttaagtaacttaaccaagatcacaaaactaatgattggcagtgtcaggattgagcccagattctctggctgtagattctattctcttaacaactgctctacaaaatcatgagctttggggtcaggcaggtctgggttgcaatcccaaccttgttaacttactactagtgagaacttcggtatgctccttttttgtgtctaagtctcagttttcccataagcaaatttcaagataagataacaatagtacttttcatgcaataattcctatgagattaagctctcctacccttctctgtgcttattacattgcttcaaaacaggaagtcttcggtgtgtgttttactaatgaatgaataaatgaataaagcacttatcatccatgctgcacaattaacattttgttgtatgctactttatattatttaacttttctgtgcatgtacttttcttgtcaatccagctagattatatgcaccctaggactaaaccacatgctttttactttaatatgtacccagttctctgaacagtgatgtgcacatagaaagcttctcaataacgatgactcccatgaatgaagcatttactatggcctagacattgtgttaagtatttagtcttcatagcgaccctagatagtaagtactaatgttaattccaatttacagaataggaaactatgccttagtgagctaaagtgattttccagtggccacaccattagtccatacagagtcagattagattgagctctacttatctacagaagtcctgggcttgatcaccatgctgtactagcttggtgttaaagccctgattgatgggtaatttgacaagaagtcagagcccattatcacctgcctttggaagggaatttcctgcatctgaagttcttgtctatttggcccacttggctcaaccacctagttcacggcttttctgtagatttctcctcttagcactccctcaacaggcacaaaccacatatccaagtcagggatgccataaacagtggctgctgctgtggctggcccacagagcatggaagcaggaatactcatgagccccctctgtcatctcagtatattatggcttcagcattctctttgcttaacaacctctggctgatccactgtgaaaattgtgtgcaatagtcttcaaaatttctaatttcatacctgtggtgaagtagccttgcggctggtcaaagagaacacctttaaagctgacagtggaaaaagccttggctcctaaccttctgcaaaactgtttttactacttcatgcaagctgttattggtgtctttatttaggctgtatttcttcatttcagcgtctatgtttagcagttatataaaggagcgaaatgggtttaatggcctcaagtggcaaagcagtgacatgtggtccttcttggagcaacaaaaggtcaaaagactgtggaggagacttcttgtttcctggtgactaggagtcaaatttcttttatctgtctgagtcaaggggaaatgatgttcctttgaaagtctcatcttgtaggtagagtgtaacagagtaggaaggtagggaaggttccttaaagggccatgcagataatctcatctgttgatttgtcctattgtgggtgatacagactcacattccctttctggagaagggagggttttaattaaaactaaatagatatccactgggtctgggtatgtacataatctagaaactgtgggcttctcaaggcctctgcattcagcatctcaagaagtcctatgggtaccaattgatccatcctggaatcactctcctctgcttgcatgggacttgcctttctgccctccttccttagcactcccaccaggctaggtatgagccccgagtaaggagccctggtctgattccagcttctttctcttattgactctgtgatttcaataagatatttgactttacaagttctgcgtcttcatctgaagacggagactataatgaaaatacaaaccttatggatttattgtgcagagtagaaggacaaagtatacaaaatgctttggataattgttatctaacatcaaaatttaggttcacatacctgatgcacagtaagccaaacactgacacatcagcataaatgtttattcaatttggccaaagtgagagggcaggaaagacagtctctaaagtccaaccttcctttacacataactgggggcttctatgagtcaggtaggtatacaggaaatgggataccccaaagaccaaagctgtttatgtctcttggcctgatcagacttctggatgccatcaaggtttgtgtgacctaaggttcatttttcttctccaaaaaaaatacagtttatcaatcttgcaggccaggggtgtaaggatatgaagttactagtgactaccttctaccaaaatgactatgtgcaagcaagcatgcatggaggcagaaaaaggcaaggaaaagagaaaactaagtaaaacaaacatcttatgattcttataataaagactcagttacacaataacgttgtgcacactaaaatcccaatgaatgggtgctgttagtataggcagctggcatatttttccctagaccaatcagtcttgtatttctgtttcaaggcagcctgcacagattctccaaagcaattctcagcttattcatagtagaatcaaaataatcaggtgaaagaaaaatttattcataaattcttaatcaaagcttccgctgtacccaccctgaagcagtatgagcactaaaaccatcctatttctttttattatactttaatttctagggtacatgtgcacaacatgcaggtttgttacatatgtatacatgtgccatgttggtgtgctgcacccattaactcgtcatttacattaggtatatctcctaatgctatccctcccccttcccccctcctcatgacaggccccgatgtgtgatgttccctttcctgtgtccaagtgttctcgttgtttaattctcacctataagtgagaacatgcggtgtttggttttttgtccctgcgatagtttgctgagaatgatggtaaaaccagcttatttttaccatctattaaatgggacaaaaacttcaatacttctacagttgttgtatacaattaaataatcttctaaatccgattgtccctccttctcttcttctcctttgataaacaacacacctctctgcatagagcaacagaacttccttttgattctggcccacaacttcctatgtacacctcgtttgtaaagaagctcatctaaagtcaaccagcaaacgatgggccctccaactctgatagcctgtcaccagccctaagctgccaggcttcctttgagtgtctgtcattggtgagatatagggacgtgtgaccattttgccatggctctatgttgctgaaccaggtgggggtgtgagtggcagtggggcaagtggatccttttgatcattagttatttttgagtattgactttaatttgtaaaatttcccatcttaatctctgccctagtctctaagcagatcccagggcattgaggagagttcaggtatgccagcatgttttggtgtttttccaatgccaaaataatattttgcccactgaattcacaagtgttttagatggtcatccagtttttgtattgacccctcctaaagaggtaacagttatcccttggtatcaatcaaggcatggttccaggacctcccttggataccaaaatccatggttgctcaagtccccaacataaaaaaggtgtagtatttgcatataacctacacacctgtgtgtatatttgcatataacctgtgtgtaggttctcccctttcctttaaatcatctctagattacttttaatcctaatacaatgtaatttccatgtaaatatctgttacactgtattgtttatggaataatgataagaaacaagaagtctatacatgttcatatagatgcaaaatttttgaatattttcaagccatggttgtttgaacctgtcatgtggaaccaagggatacagagggctgactatattttaaaaaatgaaagaatattctttgaccacagcagggggctactggcatttggggatggggacaaaaatgttaaatactttgcaataagaacattaacacacagtgaaaattgtcatgtcaatgctcccttcgttgggaaagctgcaattagttataccttttctctctcctattagagaaatcaaccaagccaagcctgagtatctcagaatcagcatccttcagactcaaatttgagtcctgactactcaacatctataagcgttaagcacttactttgtcattcaatactcgtttaatctcctaaaagaacggcaagcttcttattattgcccctactagtggaaaaaataaagccagagaaagcaaagattctaacactgagcccagcacaagtctaccaccttatgctgtttctatgacgttaactttatagcatgatctggattgctaaaaatgttcaagtttgggccttataacaatagaaagaggactatataaaactacagtaagactaaaagtagctaaaacatattacaaaaataaaaaactggagtacctcgattatatacaaaagagcctttgaaaaatgtctaggtgaatttttgtctatgtacctatgttgacatcacaaaataacaactatcaattcaaaactcattccttctatatgtttttctcatatcgattttaatcaaaaggcttaacttgaatattaatctttcatgtcctccttatctatttgaccctctggaatactgctgagtaatgtggcattcacaagaatattactgtgtccacttaagtgatttaaaatgtattctcaatagccaaagtgtcctcctgactctttgaaattcagccatcctatgtttcagatggcctttcacttgggcttttaaaccactttacagacatctctttattctcctttattttataaattgggaaatagatcaaatagaagttaagtggcatatagaggtcaatggcagattactggaagacccagggaaaggtatcacccttgactcacctagagttatccctcagataatttaacatttcttcagaagactgaggtagcctctgaatgtaggaggcagactaaaagattattttttttcatgaggctgcctcaagcagattcacatttaattgtgattcaactggcatctcctttcttgctgccacaaaatatctatattgaaatcaggttgactgttcatcttttctttctgttacgtctgctagggatcaatagagataaaaatatttggagctttgtgttcaatctaagttcctgcatgcagttgcttgatagaatgattttgtaaggaagcaagtaaccaaagtatttttgcagtgtttttgataaaggactgctctttgctggtgtcctcctctccactactaattgacaaaacatcttgaggaaaacatccatatgtttaaattatccttaaaagctctattggcattaaaaaaagacctccgttttgataaagattccaataactatttggcttttgcaagtccagctttatgactagaaatttctagatcaagagtctgcaaacgatggtctagaaccaaatacaactgctgtctgtttttgtaagtaaggttttattcgaatacagtcttgcttgctcatttaaatattgtctaggctgctttcatgctacaatggcacagtggaatagctgggatagagactatatggcccgcaaagtctaaaatatttacaacttcactatttacataaaaatttgtcaacaactgttctacattaaacaatatatcagccctggcagatgtaactggttaccttgagtatctcatagcatgtatgcagtgtaattttcaagttcccaaacaaaactttccaaaagccatttcttaagaccacacactgtagagtcagatccaccaagttttgaattatctgaacagagctttgcaaatgtcaaaccagtatagtagatgatgacgattttgctgaaagatcactccactttcatcaggggaaacaagctattgggaatatattttaggacctcaattttccacacattgctctaattactagagtgctatagatgcatatctctgatttacagtccgccaagtcaagatttctgaatttcttggcataagtttggtagtacagtattactttgattatggcttcttatatctggcataaaaatattccctttgtgcatattctttttagatacagtacaaaaaaaagtatgactcttccttttttctctccctttactttaggaaaagcagctgtgaagtcataattatgttcacttcccactggcaactggcaagccctttatttttgtgcattcggaactcaccaagaataaataaagtccattccctccttgaggggctattctgccattccatctaggatttaaaagtttgccaattcctaaaacatctattgttatcaatagtcttgtgtctttcacaaagcggactttacaaaataaggtaaggggaaaaatgtcaaaagtacatgaaaaaaatcatctctaagaaagagcaacaaatctgctagctcttaagaacttataattatcattgctggttaattggtattatagattacccagttctgacatgtaattttctaacacaaagaggtttctatcatgttacattgtgctttgcatttagggactttttattttacatttacacactaaagaacgaagggcagaagtcttgaaatatgcaaggatttagataatgaattgcatcctaaatttagaaaatatatcagacaatacagatgattcattgtagaatttgtaattctggaaaggcaagttttggggaccattgtttataaataagctaacttttattggctcagatctggataagtaccagaagcattaacgaacatttcttcagctgcacacggaccttcaaaaagttctaaaacagggtatgttattatgttttacaggaagatgtgtttaatatttgtaagtcaatatggataataacactgatttaaatggactgatagatgcatttgtcttttaatgtctattataataacaattgccaaaagcctatgaaaaattcaacatttacttgttgattagtctgtttttgattcatatatgcaattaattcttaagtgaagtttttcagagacactagcctctccttaaaaggcaaccatgttcacttgaaaatgtgaacagactatagatttgagattctggcttcacgctttgtcctgggaagcaaccttggatttggaatttaatggcttcctggctatctggactgtgaagaaatgcttctgaggggagacagatgtttgtctgaaactctattgtttaaagagctggactttgtctgtaacagcaggtatgaagatcagaaagaaagattgggagcccaaatgaaggcattagtactttgtaaacatagacctcatgccgcagtctgggtggattgatgataatgctacaaagaaaaatgcagcaaaggaaacttaggaatgaacctaaaagacacagtgtcttagtaaactaaaacgaaagtaaaaggagaccttcaaagcccactgcttgtaagatgagcttcttttttgaatattattccttaaaggacaccacacacacccaggtgaactcatggaatttgcattaaataattgataactttttgacatttatttgaagtttccttccaggaaaaaatggttcaagtagcactctggcattatttcataattaagcagccttttgcatgtaccatatgcaaccaccaaatctaaggtcctgtgttatgtagcctttccaacctttctaaatctcaagttttcagtaaatttaatgttttctttagagaaaaagacagtgagagacaggcagtgtccatttgaactagcaaatagtctgaccagatgacgagtctactagctcttctagtagctgctgcaaccagcaacttagtgggggcaacatcctcagccatgccacgtgggctttgcctgaagacaatagataacagccaagaggcagacaaagaaaatatgtgtaaaaacaatggtaaataaagtaaataaaattaacgaattagataaatgaataaaaataaagagcaaaagcaaatgtcaacatgcatcaattccccatccaaattacatacctcatgtaatttttgtaaacattttgtaagatttaccttcttgatttatcagcaatcattctggtttgcaataaaataatacctgtaagtggtttaattggaactgctgccactgcttgagatttatgaattggaatattacatgataatccacaggatcaccttgctttcctattgctgaagtttgcctcaattcttccttccattcattcatttactcaacaagcctccattgaaggtctgctataattcacataggggtccccctcccttaagaattgcaaattatacatgcaagagaaaatattgttttcactttttaaaaattatttcatttctatttttaaaaagagattgttttcagacagatgggctaccctgtacattttttactttgacaagtacattctgcaatgttttgtgggagaactgagtttatccttttgttaacttcaaaaggtcaggtatgtgcctcaatcctcatttgtttctattacaaacatcttaggaatccataaagttatataaactttcaaatactttgatatttgatgagcaaatctatgttcattctgttcataacctttatgacataccaaacaccaaccattttatctccaaattccacaaatgaaggggtcattatcacccaccaaaaagcggtttacaaagattttaacaatgtataaacaatcttgcttgaaactaatgaactcttacaatctttctgtctttttttaaaatttttgccattacttgttaaagaaagtgaccctattggatcgtgttttcacgtaataaattttctgcgaaatttactgtttagtccttggaggcatattactaaaaatcaaattggattttcttctgaaagaaggttacagagtgtgacttcatgagtggaagtatgttatggctaaagagcccatatttcatgctgtaatatagccaagttacattggtatatatattccttggccattgaaacaatgttaaacaatatttttcttttgtctaagatacagttagttaagctgtcattaaaaaataaacaaattgataatcagaaaaaaaaatcagagcaaagcaagctgtcaaaggttggctgtaaatccagcacaaggtaaaatgtggctattttaaaaagggcaacttcttcctaagataactgtttttttttttctctgcttaaaatagtcattgagggatattcaattgggaccagagaaaggggaagccagaatcattcatcaggcagatactttgtgtcagttataaacagtatatttcaaaattaagtatgagaaactccaggaggagattagacatgaggaaacaagctcagtaaagctaagaatcttgcctatagtcatctgtgcagtaagaatacactatgactattacagctaaaatatctttttaaatgccaggtattttctattctaattcttagaacaaattagagaactgagatttagagtggccccctcctctgcctaaaagcactccagatctggtcatttaatctctttggtatgccacttgtccccagggaaccaaactaacaagtttttcttctggtgtgctctttagcaaaaatgtagagtcatcagacattagtgtgtttgttgccagcttcgtgtgtgtgtgtgtgtgtgtgtgtgtgtgtgtgtccctctctcccctgcacttccaactgatttaactttccacttgtaggtgggtgtagctcagagaagatcaagaaatattgcactccctctactcaatattgtggaacaaattaaaacatgttcaatagttgtgtacctacaataggtaggagagctaggggctggggattcaaagatggcaaacacaatttatgctcctaagcaaatacacaagctcagcaatgggatagacaggatcaagtaagactgaatgtgctgtgctataatttgggcacagatcacatcctcttaatgcacaaagaaagaaagaactccaacaatgagaggagaatggatgggagggactgaggcaaacttcctgatgcctgtaacatttgaactgatctggaaggatgattataaaggattttaattgacaaaaacaatggtggaagagactgcatgagccagtgcaggaacattcttacattctaattatattcttatattctcatattctcacaggacattatctttaccaatgttaaatgattaaactaggtaataaacaaggcacacaatgatcaaaagaaaggggctctggggatgaacattctgcctttaatcactaatggtgtggcctaaactgtggggattaacaatgctctgtaatacccctaactatgcaatggggataagaagaacctctcctccacctgggcattctttattgttgtcttcataaagacttaggtgtatggaaaattgggcccagtgactgacatatgacaaagcacttgaaacatgattctatttttatcattattagttctaccaataataattatatacaattaatagaaataattcgcttccccaaaatcaagaagatagaattttaatataaaataaagttttaaactaaggatatttttcttcactagtagaatttttgactcagcatcagctggcaaaacgatttaggaaaattaaggaaatgttctagcatactccaaatcacatgatgtagttgcctacatattccaaaggctttcattctttgctcattggcatccatatttccacagaaaaggtttgcaagctcagggcatcatgctaatgtctaagacattccatcaccattaagggactttaaaattattcctagtgacaacaatatggttctttgtgttattaagtaaatcatggaataataagaacaggaagaacactatctcgttcactaaataaatgatcactatcattaaagagctattaaaccaaattctatcaggtatttttttaaagatgtgttcattctttctactcacttgctaaataagaaagaagaaaagctcaagagtctttaagcagaagctctgttctgcagctcacagaatggattaacaccagctggaaaaatctggggaaagtaggctaatccttgctaagttggtggccctatctagctgctgcagaagctgcagcatctgggactggcttttactcccaactggcttcacccttcccctataactcttatcctaatgttattcaaagagaattccatcatttgccctgatataagcatcaggcacacaaagtcaacccacagacactcctgcctatccctagaaattttgaaagctccagtatctgtttagcactagtaaatcatttcctgcttggtcaatccatattttactttgcgtatacagcctctacttttatccagttatatttaattaataaaaataattcctgtcttccaactataccaaggaaaatttcttcatcacaccattttagaacatttatttacaacatacggaaatacaattatatctttaagttaacaacttgtaactgagataagaaggcattgcttctctgagtttattttgttagagctgttcttttttttttttaaaggaagcttctgctcagaaaatgtgaaagaaataatctatctcaagaccttgctgttcttgactgttcaaaaattctttaaataaaatataatatggaagctgtgctctgcatgtcgagaccatttcactgttgagccttcacagccagaaaacaggctcaaaataattagacttgaacaaaatcacattatttactttttgctttaataaggaggtgattattagaagatgaaccatgactaccaagatagcaggtatagattctttttaacaaaattaatttagattatattcactatcttaagatacttatgcacataaatcatatctctctacgtatttttgcatgaaacatagagtatatgaaataaaatgaatgcaatgaatagaaatttaatcatatatttacctgaattattagattattcataaatagcttattagaggcagtaaaagtcgacagagaatgattgcaataggcagatgtgatgtaagtctgtgatattttagaagaaattttcctgtaaatcacacatgaaagatgcagccactcatgctggacaactgcctggtgttcccaagaaacatagggacaaccaaagggcacctcagtaagtttatactggaccatagataataaactcatcaacaaacaccagatttttgttctggagaaaaagatgaaagcttttgaacagtactagtcatcaccaaggaaactgtggtggagtaaaaaaattttaagaagatatcaacattgcagtaaatcaacctaacctggaaatgtgtttggtgacaaactgaattttcctaggtgtcggcaaactaactcttttaaggccccactaggggccttaagtgatctactccccaattcttccatagatgcacaaaaatactaactgatctattcattgtgtgtctttagaaatgcagacatttaatgggttacgaagcttaactgctagacacattcattagatgtgaacagttaatatgtagtcatttctgttggcttctaaaatatcctcatcactcttttgagacatagcagctcatcctaggccaatgatatcaaccatggctgtactgtgaactgtaatccagtatctttctctcaacacctcctctcttctcagctaagggtgttgtatattgaagatgctctgcttttccctctgactttcatcacttaaaactttgttgatttcacctgaggcaaattgacaaatatttttaatcatctttcacctttctttctcacttccaactcttctccaattgcctgactgaaatttctattccttttcctgtttttttcctacatatttcagaaatggccctgatttgagcagaaaatattaagaataatgctaataaaaacacattcatgttttcaaatgtaattaaattttaaaaaagttttatgctcaaacatttctagaaatatcctaaattacatttcagaagttttataaactatctcagctatttcttttcctcttgaagtgaatattttatcatcatacatattcaaaataaataaaatactatgttattcaattattatgttaccatactactgctgttttagttcattcagctataacaaaatatgacagactgggtggcttataaagaacagaaatttgttttacacagttctggaggctgggaaggtcaaggtcaaggcactggcagatttggtgtctggtgagggtccactttctggatcatatatagtgccttctccttgtgtcctcacatggtcaaaggggtgaggggtctctcttgagcaggttttataagagcactaatctcattcctgagggctctgaccccatgacctaattatctcccaaagtaaccaccttttaataccatccccttgagggttaggattttaacatatgaatttggtgaggacacaaacattcagaccatagcaattgcctttttctcataacatataaactctcaaactatattatatggtaattagactttagaaattagttttaaaaatctaactacaatgttcaaacaacgaattcactaggaaacttttagaaaataactgatttctaagttggagacatactatgtaactgtattaagtcacaaagctcaaattcagtttttctatttgacttcagtgtcaagattcttcacattttgctaggctacttactctccatgttcaagttatctctaatgactatatcgaaatagaacacagatgaaagcaaaaatagaaacacagatgaaagcaaaaatagaaattgaaccacaaacatgaaacaggtaacaaacagaaaatgtctctgagaaatgccttataattctaaaataaatttggaactagatttttgcagaatactgcttaagaaattaaattgtaaaacataagggaatcatttgaataagccattaataagattaatggaaaataatttattctcattttatctctagatgccatgtccagccaaataaatgagactgaacttcatggttgttgtttttacttcatcccggcaaaagaaatgaaattaaatataaaaagcagatgaccaaataaagtccaaatgaattaagtattgctcctagtataactcacagttaatataagttgactatcctctctgtagacaacacttttcatcaacatttttcaccatacagctagacctcaactaacagtcaagtgtcaaaaaaatgaatcactttagaaaccatcttaataatgagacaattgacttctggtacccaatttagaacatctacaaaaggagtggtgagcagatttccactctgatgcaaaatcttattcgttgggcattgatagctgagtgctgtgttaaggattctgaagtggtaaatcacaaagaatgctgtcaacacacttagtaaatagttaacacaggacttctctagtattaaaattcataatagtggccaggcgcagtggctcacacctgtaatcccagcactttgggaggccaaggtgggcagatcatgaggtcaggagatcgagaccatcctgactaacatggtaaaaccctgtctctactagtctctactaaaaatacaaaaaattagccaggcgtggtggcggacgcctgtaatcccagttactcaggaggctgaggcagaagaatggcatgaacctgggaggcagagcttgcagtgagccgagatcgccccactgcactccagcctgggtgacagagcgagactctgtctcaaaaaaaaaaaaaaaaaaatcataatagcaaataaatggcattcacgttataccatctccttttttgctcatggcaagtagtgtaatccctgccagaacatgggaggagacaatgtaacacatgtgccattcatttactcagaggtatacagtgtctttccttatgtgttaccaagtttaggctgtctgcacccctctgtgcactgttttttggagactgttccaatgtcactaggtaagatgctaccccctgtgatatagcaagacatattttgtgcctagagttacaaggaaaatcttttttttttctatagaaacaagactaggcatgacaagtatatgtagttttatttgttcaacaaatattgagataatacactatggttagtactgatgtatatactaaccacagtgtattatctcaaaattagatatgtatacaaagttgacccttgaacaatgcgaaggttagggaggctgacctacagtacagtcaaaatctgtgtataatttttgactcccccaaaacttaactgctaatagcctactgttccttggaagccttgctaataacataaacagtcaattaacacatattttgcatgttatatgtattatatactacactattacattaaagtaagctagaggaaaaaatattaaaatcacaagacaatatatactcactatttataaagtggaagtagagcatcataaaggtctttattcttatcaccctcacaccgagtaggctgaggaggtgggaggaagaggaggaattggtcttgctgtctcagggatggcagaggcagaaaaaaatctgcatagaagcggaccccctttgtccaagcccttgttgttaaagggtcacctgtacgtctaattttaccatagtctttttgatgatttcaggtttaatattgaaactttggctaaaattcacccatgggaaaaatagaaagtaccatggatttttatataaaaggagtcctggctatactatttacaaagcatgctaacatatcacttttcttctctgagtcttcacgttttctgaatatcaaaggtttcaaacttcagagagctgtatgggacaaatcaaataagacattaaaaacgcgttctggagagtaaaaatgctagcagatacaggtgtctcaacttacttgttaccttccatttctgtcccctactcacattgctttcttttctgtaattgtgtttaaagctgtccaaagagactctccaaatgctgggctctctgtctggaagtttcaaatgaggcttttggatgtgcatctttttctctgagggtaggattggggcaagaaagaaggtgatttaagtgtactggttgcctgggtgacaattaactgggtattgcttttagggagtcatacagaaaaatagaaaagaccagtaaaaaatgccatcctagtttgaatgctggatgtagtgaagggggttttgatgaagaaactgttgaggatcaactgagattagaaccacttggagaattaaaattttaataaggaggcattactttaaagtgaggggagggatttatcctaactgatgccttgttaaaaagaataacacagagtaaatagtcctaagaacaattgcaatcctttgtagtctgtaatttgtaattgctgcacataatttcagttaacaggccataagaggaacagtcacaaataccaagaaaggtacatacggagataattccaaccaaggtgagcacagcctacacataaacaggatgtaagtaccgcaagtcaccaaaactacactcaggagaaagtgctcgttattaacagacagtggattagtttcaatatctacaccaggggtcatcaaataggcccacagggtggtcctggatttgcaaacacagctttttgttgttgttgttgttgagatggagtttggctttggcttttgttgccctgttgtccaggctggagtgtaatggcccgatcttggctcaccacaacctctgcttcccaggttcaagcgattctcctgcctcagccacctgagtagctgggattacaggtgtgcaccaccctgccaggctaattttgtatttttagtagagacggggattctccctgttggtcaggctggtctcaaacacccaacctcaggcgatccacccacctcagccacccaaagtgctgggattacaggtgtgagccaccacacccggccgcaagtagagttttactggaacacggccatgtctcctcatttgctattgtccagttgctgcttccacactaccaggacagggctcagaagttgtgatagagattgtgtggctggaaaagcctaaaatattcaatgttctggccctttgaagaaagttaactgaatcaatctagactgttacacttacagtgaaaataattaaggattaggagttggaaggataactcaataattccattcatttgtgatgtgtattgtcattatttcattcaatcagcaaataactgtgataacatgtgcaaggaaacatgggagatgcaaaagtttagtaaagcaggtatcctgctatagtggagagagctcaggactatgcagacctgggcttgaaacccaacttgaatggattaagtggctttgaaggagttacttggactctccttaaacctcagttttcttgatcatttcacatcatcatttcataatcacgatcattttctatgggcatatctattcaaaatctctctatcagatcccccagtcaatatggagattgtggtaggcaccaagacaggaaggtgtgatttaggatcaactggatttataattttaaaagaatttatttatatgactgatgttttgtctggtggagcctgaagtaactatgcaaaatatctttgtattattactgcttgtttatgttacttatatagttatattatttcccaatcaatttcatcttttgtatttttctcttcaaaagttttgggctttacaatctcaaaacacattttcatcattcacatatttaaaaagtgacttttttcagagttttgttattgaagcagtgatacaaaactggttgactttttttctggggcagaggagagagtcaccaagtcaattgaattaatcatttacctcaccaccatatataccagacacagataagacaaactgacttttataaaatccctgcaaacccatcattacaaacattaactgggtcaatttcacctgaaggcaggattactctttcctataccaattttggatttcccagattaacccgttttttgttttgttttgttttttttaagaagtgtggcattagcaacatattcaaaagtctaaatgcttataagctgctttgaaaaacacattcaaaagtagaaacaaggttttagggaagcaaagataggaaacatgaatgagggtttagtaaacatagcataagacacttgttatcgaggcaaaaggattaattgagcagtaacatcatcagctatggttggacagaggagtggagataccagaagtgctatatccctgcacaaataaggaatctattttcagtttagactccaagcaggaagatactgctgctgcctcttgaagtacttcgttctttttctctgaagcttgaaaagtcactttacccaggagtggtgaatctggggtgctgtttctgtacctcttcacgcaacttgattggcatataaagatattgctataggtctctgggtacttcagtttctattgcctaaaatatgcttccaaaattagaaaatatgagcttaactctcgtaacagctgaagaagagcttacaaccttagaagacatagctctgtaattctgaaataactcaaaaactattttaaaatttcttcttctccagtcttccttcttccaacacataacattttcccaagggaaggcttgtaaaagcttctcaacagagaaaactcttaggaaagaaatggaaaattatagccatatcaatgaaacctaaaaatcaggcaaaatacataaaagggaaagagatgttattcctccagatttatacattcacatcttaactgatgaaagcttctctgatagaagtctgccctgaccccctgacatgacataacctccacagtcatttttttcacaatcatttcttatattctcctgctttattgtcttcatagcactctgtcactatctgaaatagttgttctgcttgcaccgttactgacaattcctcatcccccatttcaatgtagacactgaaatcagagcctcttctccatttagcttagtgtctagcacatactacacattgaataacatgtggtgaatgaatgaatgaatgagatgttccatggcagagttcatctcccacctctggttgatattcagtcccagcaaggatgtgcagctatcaagaagtaagcacacactccaatcttacatctttggggcattcttcttcggactgttgcaaaaaatttccttgtaatgtatacagagagcaactgaaaactctgaaactctaacgcattagacaaatatagatcttttaatgaatacttttatttaataaccagaatagcccttaggtattgtctaattcacagccctttatatagcaatggagaaattaaaattaaatggcttttttttccaaggtcacaagctagtcttagcttgagccagtatgaaatgccacgtctctgaactcctagcctggtgctcattttactggagccaagaagataccttcattgctgggcaaaggaatgaacaatgattgagtacctaacacgtttctaggcactttgttaactggttgtggtagacaatgtgtgttgctgacccaagcaccatttcttcttcctttcttccttacagaatcccaaatttttaaagtaagcatcccatcagtagctctagagtcagattctgtctagtctaagtcatttcatgcttagcaggtcccattacaacagccactggtccaggggtggccacgtaatttaatttggttcaatcgaattgaaggaaaagaaatgagccatgcctggaggacatgattctcttcccaccttcccctttcctctgctagttataaacagggcgatctacagcccaatggctgcctgtagccatcttgtggccataaagagattcatctttaggatgaaatcactgctgaagatagtaatgtctatatttatattaagggtcagtaaactctgcaaagaatcatatagtaaatattttagcattgccaatctgatggtccttggttcctgcagcaactattcgactcagacattatagtgcaaaagtcaccagaatgacatggctatggttcagtaatatcttgttttcaaaaaaaaaagtcatcgggctgtttaaatcattgaacctttttgacatcattgagccacatatttcatcattccttgagcttatcctgcacattaactcccaatatttgagatgatcaatttccttatgatttaaactggctttagtaagataatttttaaatgttattactaaaaccaaatcaatataattaattcagcatttatatacattattactcataatattcacaaaactcccataaagctgatattagtagactcattcttaagataagaaaatagaaccaaagtttcagagtctttgaaaatactggttcaaaaaccggcatttgaacctatatgtctaatcttctactctatgatgacccaactcccaactatctattcctcagcacttaaaagtggaagaacagtagctgcttcagtaaagttccaaacccaccaccagcttatcaaacagaaaatgatttcatgcagggaagtgtgcacttagaaagtcttttgaagggctggaggaatggatgtcagtggactgcccctgaatttttagtttctaggtcataccattatatgtgaaatccaaaagtcaggcagtggctactgctatcagttcctaccactgtagccaccatagcctcctcacaccaatggctccccagaatgtcatgttgaaccactataaacttcataactgtcaaattttacccgtagctacagctgcataaaaatggcctctgcctcacttctgatttccaaatctcttacaagtgcatgtaaatgactctagctgcaaaggagtttgggaagtatactttttaacctctccaataggaggatcaaatggagattggtaagacttctcttcagaagattgactaaggcttctccctagaatgtctggcatgtgtatctcccatacctgacaaagaatgagggcttcaagacagctaaaaaattttgaacaagctttaaaggactattttctcatccccagtcccatcagctgagccagaataatgacttcatagtaatttttccctgtacctttgagggaaagtaatgcattcattattggaataaaagtggttcatgtgtataaatcttgcccttggcaaaataaattatcaaagctcatgccaatgggagagatggcaggtccatgatgctaagagccaagttccataaagtgatagggaagcagctttcttttatccaaaagaatttatgttttatggctcagtgttggtgaggtattgatcttccaaatgagacactgtggccactgtaaataaattcaatagatgtgtagttggcctaagaatataacctcagttatttaaaacatgtggcacttgatgcagatcaccttccagtgtcctgtgtggaagaatggagcttccacccagtacaaagagtactctgggactccatgcctaagctccttaattagcatagtacatgtttgggggtaaataactccacctctctcaatcttaatttccacagccctgaaatttggacatgatagtatgggaggattcatgagaaaatgtgtgtggaatgatttgaacttcttgaagaatacatactcaggaatactgctatttgtgatgagatagtgtcagatgcataaatttgggttctttgaattactggcatacaggaaaatagcaaatctaggtcaacagagacctttttctcagactgcctttactatgaataaaacacaaaggaacttttctaactttctcagaaaagtgtcaacttctataattatttcaataaataatcttcctccaggaggatataattttaaggtgtgtgcagtgtccttttaaagacaggtttgtaggtctcactttcttttatttccaagttatcccctggcaacaagggctgtttatgtggagtattaaacaagcttcaggactgtgcacagaactcactcctattatatcttattttaatctgatattaccaaacttcccatgaactaaaaaaaaaaaaacccataaattttaagtccagtgagatttctgttttctctggaaattagagagctgaactgtgttttgtgtgagatcatccaacagtttttttaaaaaatcttacttcagaatcacattgaaatcattatgtcttctggaaaccagctgatagccaaaacatttatttaaattgtttataaaatgggtgggtggtatttcataatagttattggtttactatgcatgacctgttgatctacctgttgaaaccattattttaaaatatatttcccccaaaaatgctacttctgtatatttgtttttatcaaatataaatttacctagctcttttaagacacagatctcacccactgaattatgactaacatgaattttggaaattgtcctattttgatatgtcaggagagaacgttttactagcaggtttcattagccaaggtggaccagtgggtattttctgacattgcaaaagcagcttcaaagtgccactttcctttcctttccaggatgggtcaaataaaacaactctactccattctgtaagagattcaggcacagaaaggagaagatactgggctgctgacacattttctattcataaatgcttctgtttatagtagaaaatatgacattcaccatgagctgaccagccatcagttctgacatttatcagcgtcactttagaaacccatgtgggaaggcagaaaagcagaagggaacagaaactcacatgccacttgtagcagaatgcttgtgccatcctgactccccctctctgaaagcctgactgtgcaccatcctccttgataacaactaccaaccactgagcaagcctgcggtaggttatgtaggttctaggggaaggggatacaaagctatgttggacacttggaaatgcttagaatccagtcggggagccagcacaggaaacagaaacatctgaatgcatagccagctactggccctctacatgtatagccagctaataatgtgtgtgtgtgtgcatgcacacacacatgactagaagaggcattgtgcctggcagtgaaatgacagaggaaaggcatttattgtatgagggaaataaaagtagggaagtggtatcttaagagcaaaacatacagtctattccttccactccaaataattgaatgcttctgaatgtgcattccaaattttgagattaaatgaataaggccaacctgctgctgatggccacagtcagaaaggagggaagagaccacccaacccaggacaggaagtggagcagacttcatctggaacttgggaatgcctgcctccatgaaaaaaagtgtaagtgagatttccccctttttgatccatcttcaaccacttgataaattttcacaaaatcagtaatttcccaatgtggttgtgatggagcagggtagcttcctatttgcaagcattgggttaagcatctatgttttaaaagaattaaacatattaatataatactgtcccaatagtgcttacaaaacgtgtgtgggagacacactgctgagtttcaggaaataaacatcccttaacacaacacattgtaatcaaagaagcatattcacaaaacgttaaaactttttgccaacttcatgccagcaagcccagagggagagaacacgtatgctctttttcaatagagtatcacattatagacccattcaataaggtctgtatgagttcatttgtttccagataaagatttctgtgtgtggggagacttaacaacaaccacaaaaaaaggcttcgtggagaagggaacaaattagttggtgttttaaaagacagaagtatgtagacagtgaaagaggaatttgcaggaaatgtggtgggaagggtaccagtaaatcttaaactgagggaagagctcaggcgaaacctccagtgatcttcacaattctcaggagaatgcttatacatgatttgcacacaaaatattgaatttgaaaaaatcttatattgaattcccaagccacttgtagaatgcaatgtggcacactaatgtggtagaagggacataaaacaaacaaacaaactccctgcacaaatacccatgggaaaggaagaacagcctcacagaacttcaaaaagagaaaacaaagaaaaaaaatctcattttccaatgtatgcaaacatttattttctgagcaaagacaggattacaagtaggcagaatataagatttgaaaagcaaaaggaaaggttacatctccccaccacctaccacccacaaaccagttcatccacaggcaagctgatactgagactctacaactacatatttatacttttgacttaaatgtggccttctcttgaacagcaaataatcccaagatttacaaattaagccacatgaggcatttacacattaaagaaatgaatttttaagtctttcttaagacagagatttttgggtttggaagacagagaaagaatgagagtacttaggggaagatggcatgggttaggggtgacatttaggatgaagtgaagagacaagttatagtagcttaattcatagattaaaaggaagacctttataggaatctggttgtatagctaggagccaaacagccccttcctgatcaaaaatgttttcatctagtcttttacaatagaaatttgtttatcttgttttaaagtattctttatgtcatgcatgtaaataccaataaggtatttaaatattcccatattgacaagtatcgctttgcttctaatcttttttttttttttttttttttttgagatagggtctcactatattgcccaggctggtctcgaacttctgggctcaagctatcctcccactccacttcaccatcctgagtagctaggattataggcacaagccacctcacctggatttgcttccaatcattttctataagcaaaatgttacatgaaaatacttgtatttatatctttgtaattttgtgcaagaatttctaaaagaaaaaatcttagaaatcctagaaaaatcccaagtcaaaaggcacttgtatatataattttgaaaggtcttgtcatattgctctccatagaagatacaccaatgcatcttcccacctgcaatgtatagaacacctgtgtccccatattcttttttctttttttttttgagacgaagtcttgttcttgtcacccaggctagagtgcagtggcacgatcttggctcactacaacctccacctcccaggcagagaatcaagagaatcaagtgattgtcctgcctcagcctccccagtagctggattacaggcacctgccaccacgcccggccaattttcgtatttttagtagacacggggtttcaccatgttggtcaggctggtctcaaactcctgacctcaggtgatccgcctgcctcagctccaaaagtgctgggatttcaggcatgagccactgcacctgacctgtgtccccatattcttgccaacatagtgtattatcaaacttgttgatctttgccaatctgaaaagcaaaagtagtattcccttacagtttcaactgctttttacttgacttacagtttatctgggtagaaaatttagggatcacattctttacaggttgtggttattgcttcaaaagactctagcattttatattaatgtagagctaataaggatgacctgatttttcttcccctagaagggtctttaaccttttgcctgcttgaggagtcctttattatatttcaagtccagtagtgttaacagaatatgtcctttaaatatatagacttagatctccttttataaataagtcctcttgaattatattttcaaatacatttgaatcatccaccacttttctaaactctacaagctcatatttctttccgtagtcttctcatatctttcctgaactcttacatgaattttttgtgcttttattttatgaaagcagttgctttaagtcttattttaatttcattgatacatttaggaacaacttttattgttctgtgaaaaacgggtttgttttccagagattattctgtaactgccatttggtttttatgttctctttaaaaatgacaatacatactatgctagtttttgttgtttttaagaatatacctttttcatttgactaaaaatccttgaccagctctttccagaaaatgtggcaggggaacagagacatgttcaagtctaaaaagacagaattatatatgttatttcaattttacttcgccccagtctaccaaaatcaattctgcagagctgctcacaatgtgaaatttccttatgtcctctacctcactgatactctacctgcaaatgcagctcatctgtgaacatggcccataaagatttccctctctatttctcctcagaatcagactcagggaatttcccactaagagtccctagaccttggtcctgttgtaaagaaaaacgtgccgttttgcaataggttgtgccacttaagttagaaaggaatgctttgccaacattttctgagctctgaagttatgaccatttttttccagtgtctctctccactcacacctgtttcaccttgactgatttggggtgctcgcttcttattttgcaattcagagatttaagtagtctgctggtttcaaccaaaaatttaacttttttgctttttatttttctggttagtttttaataataattgaaagaaaaaaataagaaatggtcattttaatcagccaccataaaactaaattttttaatgtttctttaagggaatattttaactatattttgtttcttgtattgtaattggtctatttaggttatctacttttcttgagtcaatgttagtaatttacagttttctagaaactatgcatttcatctggattctagatttttttaaaatgtatatgctattttacatatatttcgttacatgtataatgattacatatatgataaaaatgatatatgttattctttttatttttaaaaagttctctttatttgtaattatatccccttatcttctttcttcaactaacttacaaagtagattggtacagattaccagatacttttcaatgttgtttaattcataattttttctttgcaaattctgatttacttgcattttacttattattttccttgatttagagtacaatactttatattaaactatgttgttttcaattaagcattttggggattgtgaaattaactctgaatattgcttttattgtatctcggagggattgatggttaatattctcactgtttgtttttaaaaagtttctaacaccaattttgattctctgtttattgtcactgttatgcattttttaatttctatggtaaatggatttaattggctattaattcattgttcttttctaaatttacgcatgtagtttaatgatatagtctgaattatatccatttggtattttgtttttaatttcttgagatgatgattaatgactaatgtctagtaaattatttcagatatttcattaatgttaaaaataatgtatattcttagcttaagtaacatatttctatgtttagtaaatatatgttgttcatcatgttttaaaaatttcctgtattcttagtttccaagaaaaaagcattaaagtgccatagaatattaaagagcaattaaaagaatgaagatctcttcatatgctggtaagaaaagtcttccatatgtttagtgttaaactaagtttggaacatctacaagtctttgcccaaatactctcagtgaagcttgcctggccatcttatttaaaattgcggcactcctcaccacacacacaaacttctcacccctcttcctctgctgtgcaatttcaccgcattgccatcttctaagatgttacatgatttgatatgtgatgcttattgctcatcatctgcttttctccactggaatggaaacttcacaagcccagtagtttttgcttcctttggtgaccaatgtgtcttggtgcctgtacatgtgggtgctcagtagttacaggttgaaaatattagtacgtgcattacggtaattcatgtaaaaacaaaaccacaagctactttggaaacaagtatatgcaaatgtatagaaaaagatctggcagtacactcaccaaattattaacagtgtttgatttgaaggtgtgactgaaaaatcaagacagctattaccttttatcagatatctttccattacctgctaaatttcatacttaaagagtattgtctttgtcattgcaatgttaaaatttttatttggaataataaaccattcagaaaacaattaaatattttgataacaaagagtaatagatgaggactatccttgacatacatgaaaatacactataagattccaatcattcaattagaatggtattgataagagaacagacctacaaatcatggaactaaacagatatctgatatagattacttagcatatgtaagaaagtaccacataacaaaagagacctttcaaatcagtgacaaatagaaggatataggaataactattagcttttggaaagacagggtaaaacaatgtaaattttcactttatatataaaaatatgagtagatttgtgaacatgaaacatagcactcagcacagaaaacatcataaataaaatttaaagtccaatattgtcttagaaaaaattttgaacaaacataaagacattaggttgagatccttattaaatcaaggtcactaatgaaaaacactaaaactctagtaaatagaccaagctcttaagtatgtagaactgattcaactataaaccaccagtttgtttctctgatttaatgggacaaaaggcacttgcagatggttactttatacagagtgactctatgaacaaagtctgtggaatccacaaacagcacacttgcagaattttgaaaaagctttgagattgtgggagtactgccctttacataaactgagacttcccacatttatttttattgtagtttaaacacaattcaaggatgctagttcaatgacaaatctgcacgaagtaaactgggacaagaggttattcaattgcccagaacaggaagaatttgtctctctatcatccctgtcaataataattagccctttctgaaaagggtgttgtagatacacagtcaaaatgatccttaaagggaggatataatttggcttacagaaatccattaccaacaaataactgcttgtggaggaaatatacaacaaagcaccacacttggaagtgataatcacagtaaatagcatccctagcctagattgggtcttatataagaaactatcatattgccaattaacaagtattttctcagtgtgatgacactttgaaatggctaaatacaaaattgggaggagaaaagaaattgcttagtctcctccctacccctcatcccctgcctccacagctccccaaactacacaagagaaaactcaataattctgtaagaatgattttcctggctcagttttataagagacttagaaataatacaacatcagtttataaaccagacagggcttggcctgctatgtcaacatagaaaatcaatccaggagtcccaaccctgctttgtggcctttagggctgcttcagaaatcaattcccaagaaggataaaaggtcactgccatggggctcaggaacacatgcctcaaattgccagctgcagagctcaattcccccagggacttggcaatttcggctctaaatgtggattcacaagggagagccatcctgaccaagcacatatgctcttttgaggtagtggccattttcatgccgacatttttgaggccctatcatgggtcaggactgagctgaggctttccatgcattgcctcactgaatctccacaataactcctgtatgagtccgttttcgcactgctgtaaagaactgcccaaaaccgggtaatttataaaggaaagaggtttaattgactcacagttttgcacagctggagaggcttcaggaaacttacaatcatggcggaaggcgaagaggaagcaaagactttcttcccatggtggaagaaaagagacagcgtgtatgtcagtgcaggaaaaactaccatttataaaactatcagatctcatgagaatttgctcactatcacaagaacacatggggaaaccatatctataacccaatcacttcccaccaggtctctctctaaacatctggggattacaattcaagaggagatgtgggtgttgacacaaaccctaaccatatcagctcttgagtagatgctatcattatcatcatcccccttcacagaagggcacagagggacttagagcatgtggctggccaaggtactaatctacccagtgaagtcagaccttttaacctttttctggtatgtttgtattcattcactggggctgccttaacaaagtaccaccgattgggtggcttattcaacagaaatttattttctcacatttttagaggctagaagtccaagatcaaggtggcgtcttctgagacttctctatctggcttgtttttttcctttgtcttcatatgatcttccctctgtacctgtctgcttcctaatctcttcttacaaggacaccagtcctattggattagggcccactttaatgacctcatttaaccttaattgcttccataaaggtcctacatccaaatgcagtcacgttctatagtattgagggttatcactttaacatatgagttggggggagcacaactcagtccatcacattctctattattgtaattgttcagatccatttatctcttataaaccaatgatcaaaacctgtacatccaactctctgcccatcccataagaaatacctggttgtggctggagaaagagctacaatatactggctggtctcacttggcatgttcttgacattcaggataggcggagtgacccagcaatcatatagacaccatccattccagtgacactcaaacttcagcgtgcatcagaatccctgcaaggcttgctaagacacagactgctgcgcctacctcagagttcctgattcatcaagctggaagtaaggcctgagatttttgcattactaacaagtcttcaggtgataccaatgctgctgatctggagactgcctttgagagccactattctatctctttcccaatcaactgtcctttctcacctcccttttaaatctccagcacctgctccctcatgttcattctcaatgcacaatctttttttctccttcactgacagaggtgaaacaattaaaagagaatttccccagtctctcactactgcacctgctcaccctcccacaagcacgtgtactcactgtgcttttcttgctgttttgaaaggtgaattgtctgtggtctttctagagccaatctcttcacatgtgcaccagattccaagccctgcggcccactcaagggcatccctgcatgtcttctcccatctcttaccttgtcaactctttccactttttgagtcatcctcctcagcacaaaagattgttactcatttatcttaaaaagcaaaaaaactaagccaacaaaaacaagaaaaaacagaaataaaaccttttactggaccctctctccctaccaggtatgactccatttctctttgcctttgcagaaaaacatttagaaagggggtctgtattaattctatccagttcctctcctctcattctctcacagacccactgaaatcaggtcttaactctcaacaaaattgctcttactgaggtctcagataaacttcaggttgctaaatctcatggctcacatttggtcctctcacattttacgccccttgacagagatgacaccactccttgatactttttttttttttttttttttttggcttgtaaggctttctaattcactggttgctagtctcagaactttgtgaatgatttatctttgcttatacctcttagtcctggactgacttgccccagattgtagtttctttttttatccactctccttcctttggggatctcatccagtctccctctgtatgccctttgttgccaaatttacatctccagccctggatgctcctttgcctcagactccaaaactatattcaaagtctctcatttagatcattcaaacttttcaagagtgactcctgatcttctcccaaatatctgagctgctcaaagctttccatctcagtagatgaaaaattcacccctctagtgcttaggtcaaaaatctttgagtcacccttgtttcctctctttattactccccccactgcacatccgattcaccaggaagtcttcctgtgtttaccctaaacataattcagagaccaattactcctcaccgcctccatggctatcactttcgtcagacttgctacattttagcaatcgtcttataactgttttcctattcccacccttgcctccttccattctattgcccacaaagaaacataagtgatccttttgaaacataagtcagatcacggcatttctttcccaaaaagaaatgcaagtgtctaaattcttcgcctacctcagggtaaaagtccaagttcttatatggcctttaaagacctctgtgtactctcctcctccctccattagttctctgatcttcccttcttcttttcttcctcatcctactctgctccagccacgcagtctttctggctatttcttgaacatagtaaacatgatccctcctctgagctttgagttgtttcctttgcctgggaaattccatctggagacttccgggcttgctcacctatataggcaagtctgtacatgagacctgctctgaccactcaatttaaaatggcagcaaaatccttcctggcaccccacctttaaaatggcaacaaaagccttcctggcacctttcctttctagctttggacctattacataatctatgtatcttttgtgttatcatctgccttccccgccagtatgtaaactccacaaaggttgagatttttgtttggttcactgatgtatcccaaggacacagttcagtatctaacttgcagtggaaactcaccaagtatttatcaaattatttgataaatgaatgtgatgataaatgaatgtgactgtaaaatgatactttatagtcactggagaaatcagtctctgacatccccaggaacaaaatcaacattctttggaatagtcattgataaagggttcataactttttgtgccatggacttctttggcagtctgtagaagcctatgaaccccttcacagattagtatttttaaatgtacaaaataaaatcaataaactacaaatgtagtaaattattttatcagaacatttttaaaattataaaacaaatttgtagctaatagtaatacacatacttcgttatccattaattgacaacatctggtagtggttctaataacgaccataattttgaagtactgatgtctagactgatatttcaagatgtctgtaataactctaacgtgatacgaatgtatctgtaatttccactgtgaataaagtcactggtactgccaatagcaccatggtttcttgcctatattcataaatgaaggaaatgttaaattttagctagttaaaaaaaaaaaatgaaaatgaggttgtattttctacagatacttaaatgaatgctttggaaacacttgtaaggagtagaaataaaagcagaaagactttcccctttcttactcccccagaaggtgctactgaattgttgcagataaggaaattgtaagataattgaaaaaatgataaaaatctggaagaattctgtgccaagactgtttttgctttcgcaagtgtctaaattcttgttctactttaatagaatcaaatctgcaaattatcagagtgatgatgtacatggttcatataaagcagacaatgtggaactccaagtatctgaacaatcagatcaaaatacccagactacatatcaagaaagcaggctgagtgtgatggttcatgcctgttatcccagcactttgggaggctgaggcaggaggattgcttaggaactcaagaccggcccaggcaacatagcaagacccttctctacaataagaaagaaaagaaaaaaaatagaaaagaaaagaaaaaaacagaaaaagaaagagctgggcatggtgtcacttgcctgtaatcctagctactagggaggctgaggcaggaggatcccttgaccgcaggagtttgaggttgttgtgagctatgattgtgccagtacgcttcaatccaggcaacagagcgagaccctatcttttaaaaaaataaaatagaaagcagtgcctccatgtgcttcaatgtgcatttatgtatttaagataaaataaactttttatgatgtatatttataatttcctatcatttttcactcacagttttgtggttttctctttcttttcttttctttccctttcttttccttccctttatttttcttcttccttttttttttattcaccaactacccaccttccctaattcgtaggttagaaggatttctctacagttctttctcttttttccaatctcttctggatgtttctttgtctcaaactacatagacattgtggaaatcagtatcttcatttcaagtctaggtgggtcaaatttgattctcttgtattttcactcttaaaatagcatcttgaactttcacctgtgatccatctataaggatcaaatgtaaggacttcaagagggcatctgcccaataatttctgtatacccagtacagcaaacagggtggtattgttgatgtgtactcagtgcatacaatagtatagtagtgttgtatatgctttgcagagagtagcattattgttgtatcagcacataggacaggacagttttattgcaacataaccaaaacataggttaaatgttaatgttgttgtacacccagtgcatagaacaacataaaattgttgttatatgttcaatgcaaaccacagagtagaatgctcaatttttgttgaatgacataaatgaattaaatggacacagcatcacctacatgcctcacctacaaaggcctaacttgtaatgggattactattgttgttttaataaattaagcaacgaatacagtttcaaaaagtacttagctttatttttcaacacagtaaatatgaatataacccatatcagtaaaagttgtttggggtcttcaatgatatcttaagactataaagaggtcctgacaccaaaagagggagaagcaccgcaatcttgcatgctcctggctcctgagaggttattgcagtctgccatactattgtatttccagtacttacatggtgttttggcaaaacctgagcatgtgttgtcaagtggctgatgaggatgtgattctgagaaaggcaccacgagataaaagatatgaatctcagctgggcgcggtggcccacacctataatcccaacacttcaggaggctgaggcgggcagatcatgaggtcaggagatcgagaccatcctggctaacacagtgaaaccccgtctctactaaaaatacaaaaaaaaaaatagctgggcatggtgacaggcacctgtactcccagctactggggaggctgaggcaggagaattgcttgaacccaggaggcagaggttgcagtgagccaagatcatgccactgcactccagactgggtgacagagtgagactccaactcaaaaaaaaaagaaagacacgaatctctttaacgtgagtaaggtttagatttttatcctcgtagaagaaacagcaacgcagagaatagacaaatctaccaaggtctcaattcctacaagttcccccagctgctgagtgtgaagccccacgaggttctttgaaaagtgttcctttgccagtctaaactgttctgggacttcattatagcaacgcctgctcaccacaggcaaggaaccagcaatctgatgaaggatttattgaaaatgtgggtaaatcagagtttttgttcccatgtgaatgattcccccggcaggcttgagctttagaagctctataaatacttactaagtaattaattgattgactaaagaaataaatgaaaaaaataacaataattataaatcgaggaaatgtaaaatatgtattattgtcacaatggatgaaaatatcccaaaagagatcatttggttgtgagttaggttttaaagtatacgcaatattagaaatgaataattgaagatagtttcaataattttaaaaactactgcccaatggtaaaagatataaaagattatgtaatttacaaggcagatgtcctatatctcttgaattattttagactgggacacaaaaagcccaggcagtcaagatgatattaaatgattcaaaaatagcattatttcaattaaacaaataaatgcccacaagacctacacaacaagctgaaaaagttaggtgcttatcacatcaggattctgtactaccttcctttaggaaaaaaatattattgaaatactaaattgtattgaaacattgtttttaaaagaattaggcaatgcatggaacatacttttgagtctttttccctgagtttcaaaacacaattcagttgtttcctttccaagaagtcaaacaaatattgttatttacaaactaggcaaatagcatcaagagaagaaaatatatttctttttactttttctgccactgaagatctactaacactagcagagaagaccattaatacataataaggccacattcaatgccccatgatttttattattctacatcaacttaaacaggggaattctaattcttttgactatgcacttcctctttttccattttcttttttttttaattaatgttaaaactttcagagctacaatattgcaatctattctttcaaagcactatttgcctattaaaagaaattccaccaagttcagacattaccttagcaatacagtagaatatttctctactaataaaaaaatcaactcctgcagttttaaccaacacctatgtgtaaatagtcttcttatttatatcacatttacaacatttccgctactcagttaaggtgcataagagcagaaactgtgacttctcagcactaggacctagccagatagtcattgccctgttcaaaataagtttaacaactgttaaatgacaagtttagatggtgccatctgaatcctccataagcactgcaaattcagcatttcattctcccattcttacttatctgtgttgattgcttcaccacctacccatttgttaaggtcaaaaatgttggcttcatcaatggctgtacactctcctccctttgaaattcttaccctattatttgcctagtcctacagattctctgcgaattctctattactacacaaatttagctttcattattactcatcaaaatattacttttgtctctttcattgtcaccaatagaatgccttctctaccttctccaacctatttcattataaagctagttgtgcttgctttctaaaaagtggatatgcttttgctttcctcccagtttcccctctgtttagatttttaatggctcccgattttctgtattatctaaatgctcagcatgtcctactggacttcactactacctttaaataacagctccccgaccagctcttgcctagactctccttgtgccttatatgaacaacaaatgtctctgtcttaagttggtttccccagaagcagattctgagacaaagatttgagtaccggtgctatattatttgggaaatgatcccgggaaacaacaaatgtctggagagagataaagagaaggaaagagaaccaataatttgtgccttgtcaagcaggtgttagaggtagggcaactgagttcaatctcattggggagtcctaaaagataatgaggaacactcttccttattatccaaccccaacccctcctgcctccaagggcaaggaaggtagagtgtgtattctccaatccatttgtcactggccaagaactgctactgcatacattcatcacttaccatttccagcctgcccaataaaaagaaagtctcaggtagagagttacaggtgattctagcagaatgccagaatgacatgggtaggcattgatgcaggactgattttatgcacataccacacagcctcacgtatacactattgttgtacataaactgttacttgtgtaggaactctcattgttgttgttccagtgaaattctactcaatctttaagcccaatgtcaaaagtcactctgattccatttctgaggaagaattaatgattcctcctgtacttccataatacttccttggagattaagatttcaacttgtactcatggttccacctttgtatcactatgcaatgcagtaatctccatttgacaaatcaggaaacagtcagaaagatcatgccagaaattacatgattcctaaaagttggagtgtggaactccaacctagccctcttaaaaatctactttgcccaataaatcagatatcctcaacctgaactgactatgtatctgctatattaaataattaaagaccaactggcctaaataaatgccctgctattcagagaaccagcactgcaatgtggaacagatctacctgccttataagcaagaagtccagtttctccttcttcaggctcttcactcctctggactgttcataatcatgagggtttcacaaaccaaaacaagaaccttacaaacttccacactcaagcctgcaaagacccagtatctcaagtaagcacttccattgggtcttgttgcagcatggtggacaatggaatgtggccccacagtctattagtcaatattggtctcctgctatggtcatctcactgctctagatgctttccagctgttcttcaaggaagcacactgaagcagtaagtgctcagtcctttcagtctcctacacagtcaactcagggtgttcttagttccaggcagcaggacagaatggttcaagcacctgtcacttcgtatgagtagtgctctttttccttcccttcctttgcttcttatccccatctcttgagccatcatgtcaatatcacactggttgttctttttaactctatttacaggtatgaatctcagcccacaaattcaggtgagcaagaaatctacagtctttacattataaaactttattttttgttgtaagagccgcctttctcgcatgactagtgggaaacttaaactcagtcccattcatgattttctgtcccttagtgggttctcagagagtgccttgggattaaggagtgggatctctcttatccttaagcatctgtccacacacagacagctactgagacaccctctgtctttctccacacggcccctctggcatgctggctcactcctgccaggcacacttgggacataaaacctttctctgagtttgtccatggaaaccatcttctcaaataccccatacagtcatttcctctcaggggttttccaacactcaaccttacttctgttgactgaggccttggtctctaccacacagggacttttacaaactatcttgctttctccttgcaagtggagacacatctctctagtcttacaggctttagtccagctctccctactgcttctggccaagatactctgtccagcctgccaattctctcttttctgtggggcttttaaaggacagataaactaactaataaaaagccagaaatattggagtgccatttgttctttctgctttttaacaccccttccctgagttgaatgagaggaagagatccctgagttgaatgagaggaagagaatcagagattcagggagaaaacaattctagattaatattacaaatgatttctccagatatacctagaaacacaaagaaataattatagccatttcatcccattggggttgttaactctgtccttactctacttaagctaatatcctaaatccttgtgcactaatatcctctttatatcccacttcctctccaaaatatatcctctttccctgctcctgttcttgtaggagtaattccagaaggccctgaccatcgctccccttttagggaggaattgctccctaaaagtccaaggtggttttctggctacaaatgtattctctaatgggatagtctacatgaaacaacagaaaacaaaattaaatgtgtcaattgatgtaacttgataaaccttaatatcaacatatttgctaccaaaggatgtggaaaaaggagcaggtggagattaaccagtgattaggaaacaaaattctgagtcagaacctggtcttctgtttcaaactttatcccttcatcataaaatacatgcatgtttctagataacgcaaccctttactcttttccaaaaggggaaaaatatctctgtgagtgtctattcctaaattctaacaagtgtcatcttagaaaacaaacaaaaaaaaattagaaaattgctgaacaatcctgctagctgctattcagttatgaagatcatagtcattctgttcgtgagatactctagagatgttattcagaggctgcttaggagaaaaaaaagaaaaatgcaaactgttagatctcagttaaataactgagtttattgcaatttaagctaatagttattcagtattcagtcaactatttggtgcaaacaaataaatattcttccacttgttagtccctaggggctttcttaatcctatctgaatttactttctgtgaatttctgagtaatcagaagttataggttggatacatcttgtgctagggacacccatggtgtaactgcttcattttttcttttcatttcaaaggaaatggtccatccaaagtgaaaattgttgtgttttatttttttttttggtggtagagtatattttcctctttgttggtgttgttattgttgctgttgttttaatcagatagttatttcaaacagaagcaatcaagttccttttttcactgccatctccctctacccttcctactcaatccatgctgttaagaaaatatccttgttagtaatgtgacataaagcagccttaaaaatccataattcagctgggtctagtggcttgcacctgtaatcacagcattttgggaggctgaggtgggaggatcgattgagctcaggaattcaaggctgctgtgagccatgatcacaccactgcacttcagcctgggtgacagagccaagaccctgccataaaaaaaaaaaaaaagattcaggcccggtttggtggctcacacctgtaatcccagcactttgggaggcctaggcaggcggatcacctgaggtcagagttcgagaccagcctggccaacatggtgaaacccccatctctactaaaaatacaaaaatgaggccgggcgcagtggctcacacctgtaatcccagcatcccagcactttgggaggccgaggcaggcagatcacctgaggttgggagttcgagaccagcctgaccaacatgtagaaaccctgtctctactgaaaatataaaattagccatgcgtggtggcacatgcctgtaatcccagctactagggaggctgaggcaggagaattgcttgaacctgggaggcagaggttgcagtgagccaagatctcgccattgcaccccagcctgggcgacagagtgaggttctatctcaaaaaaaaaaaaaaaaaaagattaataattatttttcatcagttcattcagtcttgtaattaattcttgctgtgatctgtattagcaatttcacaaacccatcagtttcttcattcgagttttggaattttttttttttttttgacagagtttcactcttgttgcccaggctggagtgcaacgacagaatctcagctcactgcaacctccgcctcccgggtttaagcgattctcctgcctcagactcctgagtagctgggattacaggcatatgctaccacgcccagctaatttttttgtgtttttttttttttttttagtagagacgggttttctccatgttgatcaggctggtctcgaactcccgacctcaggtgatccgcccacctcggcctcccagagtgctgggattacaggcttgagccactgtgcctggccgagttttggaaatttagttcaatagtgtgaactcaaagttattagaaacccgtacttgtcagacttcattctttccatgaagctccttgaagacataactctctgggattataattgcctgcaagaagctttcagaaagacattagactaaagcaattaagtgtggacatgaagacttcaagtgaccatggccaaaacctggtctgagtccatggtaatgacgacataattgacaagaatgttatttctgaaccaaaattgactgataccatttataccaagacacatcagatttttaaatatgttatacaatttttcagtatattaataacatatccatataaatatacctcaaggtgaaatatttcttattttgccaatccttctcttataatttattttatgtatttcttttttttttttttttgagatggagtctcgctctgtcacccaggctggagtacagtggcgcaatctcggctcactgcaagctccgcctcccaggttcatgccattctcctgcctcagcctccagagtagctgggactacaggcgcctgccaccacgcccagctaattttttgtatttttagtagagatggggtttcaccgtgttagccaggatggtctcaaactcctgacctcgtgatccgcctgcctcggcctcccaaagagctgggattacaggcatgagacactgtgcctggccttattttttattttatatttaaaatttttaaattttttggccgggtgcagtggctcattcctgtaatcccagcactttgggaggccgaggtgggtggatcacctgaggtcaggacttcaagaccagcctggccaacatggtgaaacccggtctctactaaaagtacaaaaattagccaggcaggatggccggcgcctgtaatcccatctactcaggaggctgaagcgggagaatcacttgaacctgggaggcggagcttgcagtgagccgagatggcgccactgcactccagcctggcccacaagagccagactccgtctcaaaaaaaataaaaataaaaataaaataaaattttttttgtagatacaggagtctcgatattttgcccagactggtctcaaactcctgggctcaagcaatcctcctgccttggcgtcccttgggattacaggcattagccactgtgcccagcctcatataatttaatatatcagataagcccagttgatttaatatttctttttttgtagatcctttgagaggttcaggggtcctctggaacatcctaaagttagtttgaggtcaaaaatacttaattttgatttttttttttttttgagatagggtcttactctgtcaccctggctggagtgcatggacacaatcatatctcactgcactctcaaactcttgaagcaagtgattgtcccaccttagcctccagagtagctgggtctacaggcatgtgccaccacgtccagctaattttgtttattttttgtagagatgggatcttgttatgttgcccaagtgggtctcaaactcctgggctcaagcaatcctcctgcctcagcctcccaaagtgttgggaattcaggtgtgcgccactgtgtctgccttaattttgatttttgaaaagtttgtcaaatatcaaagttttaaaacgcttgatcaaagtaggatcacaagtcactgtgaaataaaaccaaagtgagaaaatatttgaaagacacaaaacacaataaatactctttttttttttgagagggagtcttgctctgctgcccatgctggagtgcagtggtgtgatctcagctcactgcaacctctgcctcctgggtttaagcaattctcctgcctcagcctcccaagtagctgggattacaggtgctcgccaccataccggctaatttttgtattttaaggagagacagagtttcaccatgttggccaggctggtcttgaactcttgacgtcaggtgatctcactgtcttgccctcccaaagtgctgggattacaggcgtgagccaccgtgcctggtcaatttttttttttttttttttttgagacggagtctcgctctgtcacccaggctggagtgcagtggtgtgatctcggctcactgcaagctccaccccccgggttcacgccattctcctgcctcagcctcccgagtagctgggactacaggcgcctgccaccacgcccagctaatttttttgtatttttaatagagacagggtttcaccgtgtttgccaggatggtctcgatctcctgacctcatgatccgcctgcctcagcctcccaaagtgctgggattacaggcgtgagccaccgcgcccagccctggccaatgttcttgatgaaacagattctctgtttcctaggccagttacctaaaaggtaaagaaaaatcttttacaattttcttgtaaagggtagatcaatggtccacaaaaactctgttgttgcaacacaggggcccaaattgcggccttgtatccatcagtgtgcttttgatattaacgctcagtttttagcctaggcaacatgggaagacctcaccgctactaaaagtaaaaattagccaggtgtggtggtgcacacctgtagtcctgtctacttgggaggctgaagtgggagaatcacttgagcccaggagattaaagctacagtgagttatgatcatgccactgcactccagcctgggtgacagagtgagaccctgcctcaaaaaaagcttcaattttaggccaggcgcagtggctcaggcctgtaatcccagcactttgggaggctgaggcgggcagatcacgaggtcaggagttcgagaccagcctgaccaacatggtgagacccccgtctctactaaaaatacaaaaattagccgggtgtggtggcacacacccgtgatcccagctactcaggaggccgaggcaggagaattgcttgaaccagggaggtggaagttgcagtgagtcgagatagagccacttcactccagcctgggtgacagagtgaaactatctcagaaaaagtaaataaataaaataaataaaggaaaagaaagttcaatttttagaaaatcttataaatatttatggctttttttttttgagatagagtttccctcttgtcacccaggctggtgtgcagtggcatgatctcggctcactgcaacctccacctcctggattcaagcgattctcctgcctcagccttgtgagtagctgggattacaggcgcctatcaccatgcccagctaactttttgtatttttagtagagatgtggtttcgccatgttgagcaggctggtctcgaactcctgacctcaggtgatcagctcgcctcagcctcccaaagtgctgggattacaggcatgagccaccacgcctggccaaaaatcttataaataatccccttctaatttcggccagcttaatcacacaccaaattcctttcatgagattaatcttccacaacttctacacttccttaaatctttgattttgtcctatacttctttttttatattagcaatctactttaggacagaaatttactttcctttcctcttgattttgaccaaagtcctctcttatgcaaaatgaaaaattactcttttttcaactttctttaccaaaaatacatcctcatatttataactttttttcacatctctcctacttactggccttcttcccaccttgtttctatttccttcctaaatccatattttgaaacaatctttaaataacccccaacttaaacaaaattgctcttatttaacaaaaaacttatctcaaaaaacctagcacggtcaccaagcgtgctttgcttttctttctctctcttttttttttttttggaggcggattctcgctctgtcagccatgccggagtgtaaatggcgcgatcttggctcactgcaacctccgcctcccaggttttgagagattctcctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcaacaagaactgcatgctgggttctggacagaaatagagttataattaagcattcatcaggctgcattttggcccacttccttgttgctaaaagtcaggtggcactagttcctgaccattgcataccattgttcctgtagataggatttctgacattagagtcagaagactgttttaagaatttatttggggatcttctggggctgtatcacagggggaaaagtgaaattaaaaaaaaaaaaaacacaatcaatttgggctgggcgcggtggctcacacctgtaattccagcactttgggaggctgaggtggagggatctcttgagcccaagagttagagaccagcctggccaacatagtgcaactccatctctaccaaacaaaatataaaaattagccaggcatggtggtgagtgcctgtattcccagctccagaggctgaggtgggaggatcacttgagcccaggagttggaggctgcagtgagatatgatccagctactgcactctagccagggcaacagagcaagaccccaactcaaaaagaaaaaaaaaaggaatttagattaaaaaagaaaaagggctcgagtttgaatgcagtggctcaagcctataatcccagcactctaagaggctgaggtaggaagatcgcttgagctcaggagtgccaggctgcagtgagccgtgatcatatcactgcactctagcctggacaacagagtgagaccttgtctctaaaacaaaacaaaacaaaacaaaacaaaacttgagaatgggccagacgcggtggctcacgcctgtaatcccagcactttgggaggccaaggcgggtggatcatgaggtcaggagttcaagaccagcctggccaagatggtgaaacctcgtctctactaaaaatacaaaaattacagcgtacctgtaatcccagctactcgggaggctgaggcaggagaatcgcttgaacctggggggcggaggttgcagtgagccgagatcgtgccactgcactccagcctgggtgacagagcgagactccatctcaaaaaaaaaaaaacaaaaacttgagaatgatagtgttacaggaaaggggtccctacccagaccccaagtgagggttcttggatctcacgcaagaaagaattcagggcgagtgcataaagtgaacgcaagtttattaagacagtagaggaatgaaagaatgaccattccatagacagagcagccccgagggtggctggttacccatttttatgattatttcttgatgatatgctaaacaaggggtggattattcatgcctcccctttttagaccacatagggtaacttcctgacgttgccatggcatttgtaaactgtcatgaagctggtgggagtgtagcagtgaggacgaccagaggtcactctcgtcgccatcttggtcttggtgggttttaaccggcttcttcactgcaacctgttttatttatttatttatttatttatttatttatttatttatatattttttgaaacggagtctcgctctgtcacgcaggctggagtgcagtaccgcgatctcggctcactgcaagctccgcctcccgggttcacgccattgtcctgcctcagcctcccgagtagctgggactgcaggtgcccgccaccatatccaactaattttttgtatttttagtagagacgggatttcaccgtgttagccaggatggtctcgatctcctgaccttgtgatccgctcgcctcagcctcccaaagtgctgggattacaggcgtgagccaccgtgcccggccatcactgcaacctgttttatcagcaaggtctttatgacctgtatcttgtgccaacctcccatctcatcctgtgacttagaatgcctttaccatctgggaatgcagcccaataggtctcagcctcattttatccagcccctattcaaaatggagttgctctggttcacccgcctctgacaatagtagaagttaaaaaaaaaaaataacttctttaactccactccaggtggcatttcttagtgcctctgaaggttctgatctagaaccagcccccagctcacccagagcaaggaaagatcatgaaaacccaagcagaagcaagacactgggttccagcatcaatgctaagggctagaacattttctgatgttttgcttggaaaggcagaatttggttgtctagtgcgtccactaattggcctccatctgacaccctggagggatgggctgattagaagccacagctgctttgctcattatttctgatgaatggacatcacctggcgtctccggtgatggcgccagctcaggacccaggtgtgacctgcacaacaaagaaaagcaagatagctttgcagccaacatggtgaaaccccatctctattaaaaatacaaaaaaaaaaaaattagccggacgtggtggcgggcgcctgtaatcccagctactcagtaggctgaggcaggagaatcgcttaaatctaggaggcagaggttgcagtgagccaagatcatgccactgcactccagccttggcgacacagagagactctgtctcaaaaaaaaaaaaaaaaaaaaaaagatggctttacagccctgaggagtaaaccagtcttccccaaataattatcttatgtaagtcccagccccttggaacatgttttgaaagggctcacccatctgggcaggtgactcacgcctgtaatccctgcactttgggaggctgaggcaggcggatcacctgaggtcagaagttcaagaccagcctggccaacatggcgaaacccatctctactaaaaatacaaaaattagccaggcatggtgggacacgcctgtagtctcagctacttgggaggctgaggcaggagaatcacttgaatatgggaggtggaagttgcagtgagccgggatcataccattgcactctagcttgggcaagaagagtgaaaccccatctcaaaaacaaaagaaaaggctcacccttttcactggttcccttgtggcaaatctaaaataaggtacgtgtgctcgccgttcattcatctgaaaagttctaacagtttgcaaataccctctacccataccccacccccacgtgttgtccttttttttttttttttttatttgagacagagtctcactctgttgcccaggctggagtgcagtggcgcaatctcggctcactgcaagctctgcctcccgggttcacgccattctcctgcctcagcctcccaagtagctgggactacaggcgcccgccaccatgcccggctaattttattttattttatttttgtatttttagtagagacggggtttctccatgttagccaggatggtcttgatctcctgaccttgtgatccgcccgcctcggcctcccaaagtgctaggattacaggcatgagacaccgcacccggcccttttttttttaagagacaagatgtcaccctgtcacccaggctggaatgcagtggtgtcgtcatagctcactgcagcctggaccccctgggctcaagtgatcctcctgcctcagtctcccaagtagctgggaccacaggggtgtcccaccacacccagctaatttttttattttttgtagagatggggtcttgtcttgtcacccaggctggtcttaaacttctgagctcaagcgatcctcccacttggacctagccaggtgctgggattatgggtattagagtttaaatttctttgctcaacaccactccccattttgtggccaacagtcacattctttcttgggccacgtcattcattttcagttgcttcagagcactggtggccccttgggtgtgttgaacaaaccccagcctttgaggagttcaaaaaaaaaaaaaaaaagacaccatctctaggcggaaaatttcagacaaagaacccctgccaggaatatttcctgccgctgctcctgccactgccccttaggctgtggacctttatgcaagaacgcaagtggcaaactgccctactgtgtatgttgtggggagtgggggtactgccagagaggagagagccctattttattttattttattttattttaaagacagagtctcactctgttgcccaggctggagtgcaatggcacgatctcggctcactgcaacctctgccccctgggttcaagagattctcctccctcagcctccccagtagctgggattacaggcgcatgccaccacgcctggctaatttttgtatttttagtggagacggggtttccccatgttggccaaactcctgaccttatgtgatcctcccaccttggcctcccaaagtgctgggattagaggcatgagccactgcgcccagctgacagccctctctaaatctttaaaaattcagtcaggcgtggtggctcatgcctgtaatctcagcactttaggaggctgaggcaagaggaatgtgtgagcccaggagtttgagaccaacttgggcaatatggtgagaccctatcttgacagaaaatacaaaaatcagcctggcatggtggtgcacgcttgtagtcccagctactcaggaggctgaggcaggaagatcacttgaacccaggaggtcgaggctgcagtgagctatgatcacgccactgtactccagcctgggagacactgtctcaaaaaataaataaataaaatctttaacaattcttcagcttatccccctaccttctggggcttcttgggtctcttcccagaaactttcttcgtctgtaagcccgtttattgtatgcaattgtttaaaaaacacaaatgggtgcatattctcatattctctaccctctattttgaacgttccttttttttctttttttcagaccgagtctcagtctgtcacccaggctagtgcaatggtgcaattttggctcactacaccctctgcctcccagattcaagcgattctcctgcctcagcctcccgagtaggtggattacaggtgtgcaccgctgcacccagctaatttttgtatttttagtagagacgaggtttcaccatgttggccagactggtcttgaactcctgatctcaggtgatccacctgcctccgcctcccaaagtgctgggattataggcatgagccgccttgcctggctcaaagttcctttttggtttaacaatagatctaggccactgtgagtcttcctcattccttctagggctacctagtgttccggggttatttaaccagccccctcctaccaggcagttcttttgtctctggccctttgctacgtatattagtttaaagttcactttgcaagtggccaaggctgtttccctcatttccaggttcccagggggcagacatcctgctgcaatttcagaagtcagcacactcttctctctcctgtctaaaatacaaaagtccatgccccccactctccctcttgatactgtcctattttacttcttttcacaaccagaactctttatttttcccaaataaaaatagtccgtcttttcagattttaaaaatggaactctggccggatgcggtggccctcacctgtaatcccagcactttggaaggctgcagtgggcagattacctgaggtcaggagtttgagatcagcctggctgacatggtgaaactctgtctctactaaaaatacaaaaattagcccggatgcggtggctcacatctgtaatcccagtactttgggagaccgaggtgggcagatcacgaggtcaggagttcaagaccagcctggccaacatggtgaaaccctgtctctactaaaatacaaaaattagctgggcatggtggcatccgcctgtaatcacagttactcggcaggctgaggaagaattgcttgaacctgggaggcggagtttgcagtgagctgagattgtgccattgcactccagcctgggcgacagagcaagactccatctcaaaaatatatatatatacaaaaattagctgagtgtggtggtgcatgcctgtaatcccagctactcgggaggtgaggcaggagaatcacttgaacctgggaggcggaggttgcagtgagccgagattgtgccatttcactccagcctggacaacaagagcaaaactcgtctcaaaaaaaaaaaaaaaaaaggaaaataaaaatccctgataaaggatcaatgaccttaggataatgtcattccaggtaagtatctttaactgggtacttggtcctccaagattcagaggaccttgatccccctgaaactgtatacataatattcaacatacatagtatgtgcacacatgtgcaaacactcacattatctaaaattcatcataatcttaccccggcttctccccatactcctcagatcctgctatagcctagtgcattttctccttcctcactcccttccctccatgtgtcctctgccctggccaccaggaactttgtgctgcctccggagtgcatgaggcactttcacatctctcttgctttacaagagcttccctatgctccaactggcaaatttctctatggactgaaaaacccacatagcctttatctgtcttgtgatgtcttctccccaccctcaagttaggcatacccttctatgccctcctttatccaaacattttccccactatatcgtaattgtgtgtttaagtgccggactttccaactagatacaaagctttcccaggaaagaaatccttttcttttcttctttctttcttttcttttcttttctttctttttttttttttttttttgagacagattcccactgtgtcgtccaggctggagtgcagtggcacaatcttggctcagtgcaacctccacctccagggttcaagtgattctcttgcctcagtcttccaagtagctgggattacaggcacgcgccaccacacccagttaattattattattattattttttttttttgtttttgagacggagtctcgctctgtcacccaggctggagtgcagtggcacaatcccggctcactgcaagctccgcctcccgggttcacgccattctcctgcctcagcctcccgagtagctgggactacaggagcccaccactacgcccggctaattttttttttttttttttttgtaattttagtagagacggggtttcacagtggtctcgatctcctgccctcgtgatccgcccgcctcggcctcccagagtgctgggattacaggcgtgagccactgcgcccggcctccacacccagttaatttttgtatttttagtagagacggggtttcaccatgttggccaggatggtctcaatctcttgaccttgtgatctggctgcctcggcctcccaaagtgctgggattacaggcgtgagccaccgctcccggcgagaaaccttttctttttcttttttcttcttcttcgtctttttttttttttcttttgagagggattcctgttccgtcgcccaggctggagtgcaatggcgcgatcttggctcactacagcctctgcctcccgggtttaagcgattctcttgcctcagcctcccgagtagctgggattacaggcacgagccaccacgcccggctagtttttttttggtatttttagtagagacggggtttcgccatgatggccaggctggtctggaactcccgacctcaggtgatccgcccacctctgcctctcaaagtgcagggattacaggcatgagccactgcgcccagccaagaaaccatttctgattcacctattcactcccgcactcccactacacagtagctaaataaataaataaatattaaaaataaataggaaagaaagagagaaaaaaagaaaagaaaaagacaaaaatttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcgggggggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggaggagtttgcttcctaactctgcttccctgctttcctgtggggggtcttcccaggagttcctggggccctgggtcactttttggggtgcgtaaggggtgccgaaaaagatttagaactcggttcccttttctggagctgcgctttcatcgcgactgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtagactttctggtagccaccatccgggcttaagccatccggatagcaagccctctgattcggttgctctgtgaccttaaatatttaccctctctggtgtgttgatttcctggatgcttagctgccagactggcttatgaagtccttttagagttttctgtaaaagggctcaggccaggcacggtggctcatgcctgtaatcccagccctttgggaggccgaggtggaaggatcatttgagtccaggaatttgagacaagcctgggaaacgaagaggattcctgagatcactgtctctataaaaaatcagatgggcgtgttggtgggtgcctgtagtcccagctacttgggaggctgaggcaggaggatcgcttgagcccaggagttggaggctgcagtgagctgtgatcacaccactgcactgcagcatgggcgacagagggagaccccgtctcaaaaaacaaaaaacaaacaaactaaaaaaacgaactttttttttttttaagaaaagggctcagagccaggcgtggtgactcgagcctataatcccagctactcgggaagctgaggcaggagagtagcttgaacctgggaggcggaggctgcagtgagccgagatcacgccactgcactccagcttgggtgacagagcaagactccgtctccaaaaactaataataataaaaaattttaaaaagagctcagggtttttttgtttgtttgctttttgttgtttcttcaaccatctccttgattgttaagtgggtggaggaagactgttgtacctcgtgctccacccaggctattggaaaataaatctggtgattttcagtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggtgagagccatggggacttgaccttgctgccttctctgtctggtgcagagaaggtggggattggggagggtggaatttgaggtctgcaggataaacgtgtgccctgggagttgactgttgattgccacctgtctcaaataaattgcagtggcgtcttgccactgcttctcctgtttaactaactagtcttagaagatgctttccactttaagacatgctttatgggatagaagacacaagtcacgatttctgcatttgaagtggcagttttcatttcttttgttgcataaacccttactgggtgccagataagatctctgtcttttgggagtgcattgtttggtggaaaagacaaagcagagtcagtgacaaggtgttgtcagtgtgatatatactgagctgggagaaatcacaaggctctcctacccacatccagaaaggggacggttagagggaaggtcaggaaggcttctggaaggtggtagttgaggggggttgtgaaggaggagtaggacttagaaagtggggcacagtcgcctgggagaggagtcagcgtttgcaaagtcatgaagctaccgggacacagctgggctactgtaagtagctgagtatgtaatagaggaggctggaaaagcaggcagagggctctgagcgaggagggttatgtgggccatgccaagactcgggagtggaaggattttaggagatttccatgagggtcattttattaattatttttttgagttggggtctgcttctgctgcccaggctggagtgcagtggagtgatcatagttcaccacagcctcaaattcctgggctctggggtagctgaggtgcctaccaccatacccgactaataattttatctagagacagtgccgctctacgttgtccaggctggtctctaactcctggcctcaagggatcctcccatcccagcctcccaaagtgctaggattacaggcctgagccaccgtgcctggcctcgtgagggacattttaaaggagcacactggaacatgtggaatgggtttagactggattattcgctttgtggcggtcttcttacatcatgccagcttcttcgtggggagaggcaggtgagtggttttgccctcagttgcttatagtctagttgaagagataaagtggacatagagaactgaaaaggaacttgctaagagggtgttttctttcattctttttgttgttgttgttttgttttgtttgtttactttttgagacagggtcttactctgtcacccaggctggagagcggtggtgcaatctcagctcactgctcaacttcacctcccaggctcaagagggtcttgtgcctcagcttcccgagtagctggacttacaggtgcacaccatcatgcctggctgatttagagggtgtttgctttctgctgggcacgtccaggcatcgtgggaagtgctgtttaaattgggccataaaagggtgggtaaggtgaggacaggggaccaagtgggtgggattcagggtggagcagagtcatgggggtcgggacagacacgctgatgcacatgggagtagtggatcctcatttacactctggaagggaattgtggagagggaggtatagatgaggggatggaagggaagggcaccggcaaatattgttgatagcgagggaagggcggtattgtgatcggctttgactgtcagcctaaggaatttgaatttcattctagagatccaggggaggtgtgtaaaagacaggatcagaacgttagttcaggaagcttaatcttttctgcccccccatctgagatgtacaagagggttagaaagcagagttggagaagctgtttgggagggagcacttatttgtttttttgttttgttttgtttttttgagatggagtctcgctctgttacccaggctggagtgcagtggcgccatcctggctcactgcaacctccacctcccgggttcaagtgattctcctgcctcagcttcccaagtaggtaggactacaagcacctgccaccatgcctggctaatttttgtatttttagtagagacggggtttccctctgttggccaggctggtgtcgaactcctgacctcaggtgatgcacccaccgaggcctcccaaagtgctgggattacaggcgtgagccactgcgcccggcagggagggggtaaagtgagaggcataagggtcccggccaggtgttagcagggggcttcagaggtgaggagagagcagggcaggcagctgctaggcctgggggagcgggctgcggaggactgagaatctgaggtttttctcttggccgcctgggggaaatccagggggaaaaggagaatgaggaaggaagatgcgtttggcctcagacgtgttgaaggtattaagaggccaacaggaaatgaggccatgggctagagagaagagccctgattcattccccaaatgcctcccgaaattctgtgcgccgaggcttgtgtttggcacttggagtacaaagatgaattcagcagtctctttggtgtttgccttatcagctaagctgagaacaagattgattagtacacactcctcagtgttcatgcctgacctacttttccttatttagtaagttatttttaataaatgtagtaagttctggcaatctaggcacccaaaacaaaagctgggatcatgaaacaaaagtatatatctaatcttttttttttaattttaaaaaactttaaaaagttttctactttatcaggtccccttagaacatctaatcatttcatttgaacttgttttctgttcttaccctgaggtaatcattatctcctttctttcattttttttcttagttttatcttacatgtgtatttctttgtttctctgtctcttttttttttttctttgaggcagagtttcactcttattacctaggctggagtgcaatggcacgatctcggctcactgcaacctccgcctcccgggttcaagctactcccgattctcctgcctcagactctggagtagctaggattacaggcatgcgccaccatgcccggctaattttgtatttttagtagagacagagtttctccatgttagtcagactggtctcaaactcctgacctcaggtgatccacccgcctcggcctcccaaagtgctgggattacaggcgtgaggcaccacgcctggcctatttctttctttttttagagacagtgtctcgccttgtaacccaggcagctggagtgcagtggcatgatcacggatcactgccgccccaaattcctgggttcaatggatccatccccttcagcctcctgaatagctgggactacaggcacaggctaccatgcttagctaatttttaaagtttgtgcagaggcagcttcactgtgttgcccaggctggtgttgaactcctgggctcaagcaattcacccgccttggcctcccaaagtgctgggatgatagacatgagccaccatgctcggcagtgttcatctttcgtagctattgctagaccatttcctgaatgaagtgcttataccagtatccactttaccagcagtgtcctgtgtcttgcagctccacagtcttaccaacatttgctgttggccaagtgaatgggtagaaaatggaatctttgggaacttggtttctaggtccctgagccctgctgctgaatatctcctcttatgtttattggcatatgtgtttcctgtgaaatattcatgtcttttgccagtttttcattagggttcttggtgctttattttttgttgatctatagggctctttatatattgctgattttaatccttcgtgtctattgcaaatatcttctcccagcttttaacctattattcctctttctttaaggtgtcttctgttgatcagccattcttcattttaacatagcgaaatgtattttttccctagtactcagttttctgggtctggtttgaagtcttttcctgaacataacccttgcctttaaggagcgtatgcattctccagtggaggagacagataatggcactgagacgtcatgtgggcattgattgttagaagtggccacttctgcctgtggagcgggagcgaacttaggaaagatctcacagggcagagtcttgagctaggaattaagagatgagtaagtggacaagtgcgatgggcattctcagtgggggacgaagggcatgaaacatcctgacctgccctgggcgctgccaggaggtccagatggcaggagctgatggtttgaggggctcgggcagggcatcccgaggacagctttgggtgatctgtatgcaagggaatattgaagccatgggaacagatcctgaggatccgggcggaatggagagaggaggggaggaggggagagggaggccagggcctgattcccggatgcagagaatgttatcaacgcctggtgtggctctggggagcacctgggacttcccaggggcgggtgctgttggcatgctgcctgctgtgctgttggatgctgtatttcacccttaggtgttgggcaaaggctgacatgtctgcagagggcagggcgtgttgttggcaaagctagccagaggcagagcactctctcactttttgatagagacatgagttcagagaagtattgctcaactgtaggagtgtgaaagtacagtaatagatgtgagggaggccacagggcagaggtctgcaaacgatggaccctcagccaaatctggcccactgccatttttttttttttttttttttttttttttttgagatggagtctcactctgttgccaggctggagtgcaatggcacgatctcagctcactgcagcctccgcctcccaggttcaagaaattctcctgcctcagcctcctgagtagctgggattacaggcaccagccaccatgcctggctaatttttgtatttttagtagagacaaggtttcaccatgttggccaggctggtctcgaactcctgacctcaggtgatccacccccgcttggcctcccaaagtgctgggattataggcgtgagccaccacgcccagcattttttttttttttttttttttgaggcagggtctaactcctgcccaggctggagtacagtggcacagtctcggctcactgcagcctccgcctcctgggttcaagtgattctcctgccccagcctcccaagtagctgggactacaggtgcacgccactacgcctggctcatctttgtatttttttggtagatacggggtttcactgtattggccaggctggtctcaaactcctggcctcaaatgatccacccacctcggcctcccgaagtgctgggattacaggcgtgagctaccgcattcagccccactgcctgattttgttcataaagttatattggtatgcaacccctcctgtttacacattgtttatggctgttcttgtggtctagtggcagagtcactggaaagactttttctgtcctttacaggaaaagcatgctggccctagccatagggagtcgtggtagctgtggccacccagagaggacgttccagccaccattgcagtttagctggtgttgctaggtagatcatggatctaggtccagcctgcaaatattgccatcttttctgattttcaagggaagcttgaaatctagatttttttttttttttttactgtgaatattccttttttttgagacagattctcactctgtcgcccaagctggagtgcagtggcataatcttggctcactgcaacctccacgtcttaggttcaagcaattctcctgcttcagcctcccgagtaactgggactacaggcgctcgccaccacacttggctaattttttgtattttttagtagagacagggtttcactgcattagccaggatggtctcgctctcctgacctcatgatctgcctgcctcggcctcccaaagtgctgggattacaggtgtgagccactgagcccggccaaatattccaatttttaaacatcagctcagtttttaaaagccaaaccttagtaacccaagcaaaacacatctacaggccagtttgtccgtcgtcagtctgtcttggtgggaaagacaggaactctggaaacagatttgggttttctcagcccctggatatccttgggcaagctgcatgtcttctggtgactcacttttctcagttgtggtatggaaatatcccgcttccccagttgtgaggaccaacgagaattactagtcaggtggaggggcttagcacggtgcctggtgcctggtaaacctttacctggtagccattgctgttattcatttatttatttattttacacaataatttacttattgagagccttctctccccgcccttgcagtctctaggtcactttttccacttgtagattttgtgcccaagccccagaaagatggctgggggcaggggctctgcgtactattcgatgagacccataacgtggctgtaactgtctttctcatactgcaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgcttttcttgggcataaatatctgatttctggtttccattcggtctttttttttttttttttttgagacggagtcttgctctgtcgcccaggctggagtgcagtggcgcgatcttggctcactgcaaactccacttcctgggttcacgccattctcctgcctcagcctcccaagtagccgggactacaggcacccgccaccgcgcccggctaattttttgtatttttagtagagacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttgtttaaagagacagggtctcgctctgttgcccaggttggagtgtagtggcacgatcatagctcactgcaactttgaacccctaggctcaaagcagtccttctgcctcagccagtcaaagtgctgggatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccgcatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacacagcggtggtggtggtttggtttatatttatgaccttttaaaagtgtttggcattttcagggaggtttgttttttgttttgttttttgaggctcatgttgcccaggctggagtgcaatggtgcagttctcggctcactgcaacctccgcctcctgggttcaggggattctcctgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaaaaagaaaaaaaaaggtcttctatcgtttctccactcaaagacagctgttaacattttattgacttctatggagtttgccctatgcttctgttttatgtaatagagacagtgctgtagtgaatagcttcacgtcaacatttttctataattttctgaagttagagtcttaattattggatcaaaggaagtgaacatttttaaacctcttgatacatatattaccaaattgtttgcttttccgttttttttaataaatagagatgggggtctctctgtgttgcccaggctggtcttgacctcctggcctcaagcgatcctcttccctccacctcccgagtagctaagattataggtgtgagccaccatgctcagccgctgattttaacttgtatgttttaaacaaaatttctagtaaagtagaacatttctttgatatgtttgtgtcaggatttgactctcccaggtctttggagaggctttctaacaaggcatcccccgtgggtggccatctgccctgtgagaaggtcatttctagttccaggtcacgcacagtgtgtcagctggtggggtgtggagtttcaggcccaggcctcctggaaagtgcccgaaagagaaacggcttagaaaataaggactttaacggtggtgtgggttgagtttggaaagtttagaccatgttagtggaatcagagctgggaagaggttctagaagttacctcctctcactggtttccagtccacacttctcagaactctcccattttgcagtcaggtgcagtggctcacatctgtaatcctagcacttgaggagaccgaggtgggcagatcacttgaggccaggagtttgagaccagccctggccaacatagcgaaaccccgtttctactaaaaatacaaaaattagccaggtgtggtgtggtgcacacctgtagttccagctactcaggaggctgaggcatgagaatcacttgagcctgggaggcagaggttgcagtaagccaagatcgcaccactgcactccagcctgtgtgatggaaggagactctgtctcaaagaaaagaactcacctattttgcaaaggagcttcatggttctcttgaagaaaaataggaatggaggccacctctgtgtcaaaaacaacatcccacatttctgtgtttcactttttttttttttttttttttgagactgagtttcactcttattgcccaggctggagtgcaatggcgcgatctcggctcactgcaacctccacctcccgggttcaagcgattctcctgcctcagcctccctagtaggtgagattacaggcatgtgccaccacgcccggcaaattttgtatttttagtagagatggggtttctccatgttggtcaggctggtctcgaactgccgacctcaggtgatccgtgcctggcttacttttttttttctttttctttttcttttctttctttctttttttttttttttttaagagatagggtcttgctatgttgcccagactggtctcaaacgcctggcctcaagtggtcctcccaccttggcctcccaaaacgttgagattacaggtgtgagtcaccacgcttggcgtgttttacatgttgacggacagcatataatcacatgtataagggtttctgcttgtaaaagtctggaaacccattctaactgccagaatcacaaaacctagagaaggggacataactgccctgtggccacccagtagcttttatcttctctcgcgacggcagaggcaggacagccagcattctggtgaggattgaaggattagttgtaagagatttcagcaggtctgcagtgatcagatgggtttctcacatattgttaagttgaaagtagccgtggctcagtatgagttgagtacctgtttaaaatctgcattcaaagccttcttcccagaggccacaactgcagtgagatccaagtgtgtggctcacccgccccggggctcacagctgggcagggtgatttccactcaaattcttgtgccagtgcagatcttgttctaaagcttttctaaatgcctggagactagaaagacttttggatacttttccctttttcttttggatgaaatttcatctccagtagaacagcagcattccatggtgcctcagccacgatcctctggagagagatttgcggcgaagacctgacgagagactgtaaaggaaaagcagggtttgtttttcctggtcaaagttgttaatactaaaaaaaaaagaagaaaaaaaaactttggccaggtgcagtggctcacgcctgtaatcccagcactttggaaggccaaggcaggtggatcacctgaggtcaggagttcgagaccagcctggccaacatggtgaagccccgtctctactaaatacaaaaaaaaaaaattagccgggcttggtggtgggtgcctgtaatcccagctacttggaaggctgaggcagaagaatcgcttgaacccaggaggcggaggttgcagtgagccgagatcacgccattgcactccagcctgggcaacaagaatgaaactctgtctcaaaaacaaaaacaaaaacaaaaaaaaccctttgatcattaaaaagttatatgactattttagaacatttgcaagtacagaaagaggtaaagaaagaatagcccaggtgcagtggctcacacctgtaatcccagcactttgggaggctgaggcgggtggatcacttgaggtcaggagtttgagaccaacctggccaatgtggcaaaaccacatctctactgaaaatacaaaaattagccaggcgtagtggtgcgtgcctgtaatcccaactacttgggaggctgcagcaggagaactgcttgaacccgggaggcggaggttgcagtgagccaaaattgcactgctgcactcctgcctggcgacagagcaagactccttctcaaaaataaaaaaaagaaaaaaaatcccataattctttgattccagtgacattttagtgttgttctttccagacttttaatttttaattaatttatttttatgagacagggtctctgtctgtcacccaggctggagtgcagtggtgcaatcatggttcactgctgcctcaacctccagggctcaagcaatcctcccacctcagcctcctgagtagctgatactacaggcacgcaccaccacaaatggctaatttttctagtttttgtaaagacaggcttttgctgtgttgcccacgctggtcttgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccccggagcagaaggctcacccctcctttggtgtttcagagcctctgggatattgggcacctgaagaactgcagccgcagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtgggtatcaaaggtggcgggcttggtgtgagtaggaacagtggctggtcatggaggggcttgtgtgccttgtcatcctctggagtctccagtaccctcctagggcctgggccatggcgcgccctccattggggaggctgcgtgccttcgtggaaagttttagctgaagtcctcgcctatatttcccaggctgttttgcagagttgtgagagttggttcatcgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcctgcccgcccgcccgagggcactccaggtctgatctttggggcgggttgtgggcttttgtcggaggaattggcagctccgtggcgggcctggcacccacagagctgccaattcctgtgttcggagttgttgcaggcctgactcacctgtgttctcatgctgtgtactcagggctgcccttgtggccgttcctccttgagactgaaagggtgggcaagtgctaggggtgaggggccaggagaggcagggaggccaagatgggttgactctctgctgtatgcctagtgctgtgtgggcaccttatacacacccgtctgtgttatcctcatgaaaaacacttaggatacatgttgataactgcattttcccaaagaaagcaagcttggcgagcttagatacttccatcaagatgatacaatagccaggcatggtggcgcgtgcctgtagtctcagctgggtgacagagggagacccctgtctctacaaaaaattaagagatcagttgagtatggtggcacatgcctgtagtcccagctgctcgggaggtggaggcaggaggatggctttagcccaggaggccatggggctgcagtgagtggtgattgcggccactgcactctagcctgggtgacagagtgagactcggactctaaataaataaataaatgaataaataaataaatgtcaccttttattaagtagtgtatgtgtgaccttgagttattcaaccaaggtcacacatacatgactaagaggcagcacagagaacaaacccaggtcgggtctggctctaaggcccattttcttagctaggagggctcagtctgagcttcaccttgggcttcacttacaggccctgcttaaagagggggaaaggaaaaggagagaacgaccctcgtctctcaagcactatacaccctcattgtgacaacacgcccatgaaggaccctggccagtagggcccccactgatacaatctggtgattcccgagcatacacatcatattttatccccattttgccaatgaggaaactgagacccaggtagttacagtgacgtcctcatagtcgcgtggcttgtgataagatggggaccctggcttctggtgtggtcccagactgtactaccccagcaaggtttcagtgagaagggtaagaccaccttccctggaagggagacagatgtggagcagcacctggaaagaagcaggcctgggctctggcatcagtgtgcacacacactgcatcagctctgatttttttttttttttttttttttgtagaggtgggacctcttgtcactgaggctggagtgccttgggattatagctcactgcagcctctaactcctgggctcaagccatcctcctgcctcagcctcttgagtagctgggactattggcatgcacctccgcacctggctaacttttaaattttctgcagagatgggatctcactgtgttgcccaggctggcctcaaactcctgtgctcaaaccaccctcctgtcgcagcctccctaaacactggcattacaggtgtgagccaccacacccagtccccttgacctctttcagccttggtttcctgtccgtaagtgggagaaatgtcaccttggcagtctgtgcagcttaggagagacaagtacatttgatgttggttactaaatgttggaccctggaccggcactccaacagccggtgccctggggggcagccatcaggtggggcatttgcaggcctcttcttattcagacagctccaggtgctgagcggaatcattgtccacattcactctgtcattctgaagcggtgtgtagaacattctagaacactcaccacgtggcatgcccctgctgggtcccggtgatgcagctgtgaatgaagcaggcttggggttgctgccacctggggaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgagaccagcctggccaacatggtgaaaccccgactctactaaaaatacaaaaaattagctgggcgcagtggtgcatgcctgtagtcctagctactcgggaggctgaggcaggagaatcacttgaacctacgcgggaggtggaggttgcagtgagccgagatcacacgcctgggtgacaagagtgaaactccatctcaaagaaaaaaaaatacatgcatgatgaaacacactaagcagttgggtcagaggggaattatcagtagcaagaaagaagctgggctggtgactagcacccggaatttatgctctctttcttcatgggcctgtgcggtggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctaggagtttgagaccagcctgggcaacacagacatcatctctacaaaaagtaaaaaaatgagctgggtgtggtggtgaatgcctattgttccagctgctctggaggctgagttgtgaggattgcttgagaccaggagtttgaggctgctgtgagccaagatcacactgctgcactctagcctgggtgagagagtgagaccctgtaaccaaaaaaaaaaaaaaaaatcagctgtggaaaagcatcacgtgtttcccctgcgctgaggctgactctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggcccgttacattattgacctccccagctggacccagttccgccaggacaccggtaagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccgaccacagaggttgaagggttcctttggccggcaggccagcatggaggtggtgcgtcataggagttcagagggccctgtcccaccactcagtggctgtgtgccctgggcaggcaactgcgcccctctgcgtgtgtgcgtttctgctttttggtctgcgatgtgttttgatcttttttttttttttttttttttttttttgagacggagtctggctctgttgcccaggctggagtgcagtggtgcaatctcggctcactgcaacccctgcctcctgggttcaagtgattctcctgcctcagcctcccgagtagctgggattatagacatccgccaccacacctggctaatttttgtatttttagtagagacggggttttgccacgttggccaggctggtgtcgagctcctgacctcaggtgatctgcctgcctcggcctcccaaagtgctgggattacaagcatgagccaccgcacctggacctgcagtgtgttttgatcagtattattgagaatgaggcaccagtttcctctcggagccatcccttactctaatctggtggttgtcactgggggtgattttgtccccggggccatctgacaatgtttggagacactgttggttgttacagctgagtgggtgggaggtgggggtgctcctggcatctggtgggtggaggccagggatgctgctcgccatccggcagtgcactgggctggccctgcagtaaggaattattggcccacagtgtcaccagtgaggaaacttgagaaactggtttttccttttttttttcaattttaattttagttttattttaaaaagtatgggttttttttatcgtgtttgtttgtttgtttgtttgttttttgtaaagactgggtctccatcgccctgtgttgcccaggctggtcttcaactcctgagctcaagtgatcctcctgccttggcctccgaaagtgttgggattacaggcttgagccgtcatgcccagccctggaaactgtgtttccaggagtgtcgtagagtctgtgaaaactgtggctgtcagtcagctcccaagtcattgccttcacagtgtgtgaagtcaactgacaaagatagcagacaggataaataataacatggaaattgcatatcgtggcagagagcaggaagtgttaatcggggaatgaaagtggcaggtgttgtagaggtcgatttgaagttaggtgggtgtggtgtcatgtgcctgtagtcccagttatttaggaggctaaggcaggaggatcgcttgagcccaggaggtcagggtggcagtgaactatgatcacatcactgcactgcagcctgggtgacaaaggggtaccctgcctctaacaataaataaataaacaaatagcagcatgactgtgtacctactgtgttcctatttgtttattttggcggttgaaaaaagaatttgaacgttccctgtatcttggggatgctagcagactaacctttggttttcctttgaaaacaggcaccatgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtatcaggccgctaccgccactccatgaccaacctccctgcataccccgccccccagcaccccccccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcaggtatcgtgggcaacggccgctcgttttgtctgccctgtgtttctgctcttagctgggaagactcaccccaattcctgcagatgcggctcctgccccctaggtggtcctgccgtggcatctcatttgcatgtggcatgtgggtgccgaggtgccgtggccgtccagagcctacctgaccccttgtacctgagtcctggcagtcaccacacgggttagaatctacagtcctttcactcacgatgattaagggcctccacatggagcagttaaaggcctgtggcctctgcttgcgggctgcatggcgagcattgtgcccgagaacactgggtcactgcctgtacactgactcccgccttgtgccaggccctaaggacccagagaccagagtatcagcccttacccctgagccctagtctagtgcaaggggctgtcagcgcggtgtgagggagggcagaatgtggagcacgtggcagtggctgcaggtggcacgggtgacctggcccccgtgatgatgcagcccagcccagagtgcctggtagagcgctcagctccttgagagagagagagaatgataccacgggcccagtgcagaccagagcgggtggcatttaaaatgaggagattggtcaggcacagaggctgacacctttaatcccagcactttgggaggccaaggcaggaagatcatttgaacccagcagtcagagaccagcctgagcaacatagcgagaccccatctccacaaaaaaaaatttttttaattagccaggcatagtggtacacacctgtaatcccagctacttgggagactgaggcaggaggattgctggagaccaggaggtcaaggcagcagtgagctgtgatcgcgccactgcgcttcagccccctaggtgacagagcgagaccctgtcttaaagctgggcccagtggctcacgcctgtagttccagcactttgggaggccgaggtgggcggatcacctgaggtcaggagttcaagaccagcctggccaacatggtgaaaccccatctctactaaaaatacaaaaattagccaggcatggtggccagcgcctgtaatcccagctacttggaaggctgaggcaaaagaatcccttgaacccaggaggtggaggttgcagtgagccaagatcgtgccactgcgttccagcctgggcaacaaagagcgaaactccatctcgggggaaaaaaataaaaaagataaaatgaggaacccccccaggatttccctggatttggccaaggtgaatgggctggccgtagccctctgactgtctgggtgacttggggcttcgtcattcattattgagaatgttgggcttggagcacattttgagaattcagagtggtagctgggacagggctttctgagagtgccctggtgcgggtggtgagggagtgggtgggcctggggccgccctggtcccagggaggaaatcatctcctttctccgcactggccctggtcggcatcctgctgcctccctgctcaccggcccacccctgcccaccgcagccacatcaagggctgaaacttcacagggtggttgagaccgccttggcagcttcttggacctctagtatttgttcagactgggtttccgaggaccctgccagcttgtgtaagacacagtgacagcgcctcccgctcattggttcgtgtcatgtgccaggccctcctgagcaggctgcttgagtgacttcactcatcccacgatgctctcaggctgagcagtgttcttcgcttacaggagagcacattcaggcccatgaggttggcgacacagccagcaagtagcggagctgggattcagcccagaccccaagagtgggctatctggggcacatggggagttattgacattcccgggaaggcagggggctcttttaatacattttaattttattttattactatttttaaagacaaggttttgctctgtcacccaggctagcgtacagtggtgcaatcatggttcactgcaggcttgaactcctgtgctcaagtgatcctcctgcctcagcctcctgagtagctgggaccacaggtatacaccaccacacccggctaatttttcagttttacgtagaggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttccggggcatcttctgccaggagttggggcacgtgcatctgagatctttctgggagttgggagtataggaaggtgtcatcggggctctctgaggacatagacataggcaagccaggctcagggagatgctcccccaacttccctccctgagtatctgggtcagcctgtttcagagaacagtgtgctctatctgctggcccaggagggttcttagaggtgctgggacttctgtcagccctgttccactcagcttcctggagcttcttaagttcttaggaattattttgaggcaaatttctagatagtgctagagctgggattctggagttaagtcatttaatgtggatttgttcctttctcctggtattgggcctcgttggtctttcctaaaccatttccgtttctcccagtatttctctggggtccccgtccctggcctgagggcccccagaagtgctgatgtgggtcctaccggtgtgggccaggcaagttacagaaaagaaggtggatgggccagtctgtcttcccttggtgctggggtgggcatgctgtggcttgccccacgttgtaagtcaggagggaaccaggccagcaggctctgttagtggaaacagcctcaaaggggcctgcctcctggggtaggtgtaggtgcatcctgattcctttggttttcttggagctgggagaggtgtaattcacctgcacgagcctatctacgcgctgaaaaacaggcttttcccctgcctgatttgtagtgaggccccctgcagttaaccctcctctgacggatgtagagccagatggggcttagtaaatacctgacctcttaacctagcaggcggcaaggttctcacagccaagtgcatgtcaacagcatcaggtgaaagttaccttggatgtgaggaggcaggcagggcaggcagggcccgtctagagccagcgccatgggctggggaagcccgagaaccgactttttactggcagccactggaaataccatgtgagcgcgtgaaattgaaaaatttcctggaactcacgtgcacagcttccacgtgccccctgggaacaggccgtgatacaagaaagcgtgtcatctggggctgagctgctgggtggcagtagatttcctggtagctgaagttgatccctttaagcaccaaaacttgtgttttaatgatgttggatggaaatctttcctaaatgtgtcatgcatgctcttgtctcccttaatggagagagtgtgacactgcttagcacttggatggcttggggtggtggttatgaccagcagtctgtcacagctcagcgaggtgaagcctgtgggcgttttgctctgtgctgaatggctcagtggccctgcaaaacggcgctcagctcttggtggctttctgttgtggtgggctgctgctgctgctgctgctgctgctgcccttgcctctaaaagaactcacttcctcttcctcctgctgccacctgtcttttggcttgtgggattggagtcatggggcccagatggagccttgctcctgacttatgataggccctcggtctcttttcttctctatttttttcttctttcttttctttttctttgttttttgttttgttttgttttaagagacagggtctcactctgtcacccaggctagagtgaagtggtgtgatcgtggctcactgcagcctcaaactcctgggctcaagggatcctcctgcctcagcctcctgagtggccaggactacaggcttgtgccattgtgcccagctaattttttaaattttttgtagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcaccactgccctggcggcctttgggaatcatcctcacaggtagaggaattgaggctcgggaaggggacttgccatgctcagcacacacggctttgagcgggagcatacgcctctagcatcgtctccagcctctgcagctcatgggactggctgccagccccaatcccagagggtgtggacttggagaggggctttggatctccttcctctccggcctcctggctttgcccctcgccctgcatagaaaactcggagtcctcatgtctcacgtttcccactctgtctgggatctcctggagatggtcacagacaggaaagccagggagggcctaataggtggaccaggagttggggagaggaggagggtgcctgaggccatgactatagggacttctcagagaaggacacttcaggaggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctccattcacagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagcccctctgggccagtgctgcctagcctgctgcatagcccatttgttttgtagacttgcagtgccaaatttcagctttctgggctccaactatgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatacaaaaattagccaggcgtggtggcgggcacctgtaatcccagctactcgggaggctgaggcaggagaattgcttgagcctgggaggcagagaggttgcagcgagccgagatcacgccactgcgctccagcctggatgacagagtgagactccgagaaaaaaaaaaaaagtggggggaagagttgaaaccagctgaggaaggggaggagcttgctccaaatgaatgaaactgagtgttcagtagagtcaggaccttgacccaggtgtccagactccctgcccttcttagcattatcagggcccccagatccactaccagccttgcctttggatcgggagtaggcaaggagagcaagaagctgctctttgcttagcacggccacagaggcaatcctgtttgagaacagtcaacaaacaaactcaaacaggccatgcacagtggctcatgcccataatcccagtgctttcagaggccaaggtgggaggatctcttgaggccaggagtttcagaccagcctggacaacatagcaagattctgtctctctctctatatatataaaattagccaggtgtggtggtgctcacttgtagtcccagctactcaggagggtgaggcaggaggatcacttgaacctgggaggtggaggctgcagtgagctatgatcgcaccattgccctccagcctgggtaacagagcaagaccccaactctgggcccagcatgcttccagtgtgtcactctaccggcatgaccctacctcttaaaaaaaagaaatatgatgacttaagaccaaatgagtggccaggtatggtgtctcatgcctgtaatcccagcactttgggaggctgaggtgggcagatcacctgaggtcaggagtttgaaatcagcctggccaacacggtgaaacccctgtctctactaaaaatacaaaaattagcagggtgtggtggctcatgcctgtaatcccagctacttgagaggctgaggcacgagaattgcttgaacccaggaggcagatgttgcagcgagccaagatcatgccactgcactccagcctgggccacagaacgagactctgtctcaaaaaatccaaagaccaaatgagtgacttgaacataatcattgtagggaacacaaccctcatattaaaaaaaaaaacaacaacaacctttattttatggtaattaagttccggaaaagttaacaaaagtagttgggtttccatatctccctcatctggcttctgacattaacagctttcataaccatggttcagttgtcagatccagaaaattaccactggttggctgggcacggtggctcactcctgcaatcccagcactttgggaggccaaggcaggcggattacgaagtcgagagatcaagaccatcctgggcaacgtagcgaaaccccgtctctactaaaaatacataaattagccgggtgtggtggcacgcacctgtagtcccagctactcaggaggctgaggcaggagaatcgcttgaacctgggaggcagaggtttcagtgagccaagatcacaccactgcactccagcctggtaatagagcgagactccgtcccctcacccccgcaaaaaaagaaaattaccactggtataatactcttaactaaaggttttttttttctttcttgatttttcaccaatttcccactactgtcctctttctgtcccaggatccaatccagggtcccactttgcttccagttcttattctccccgtcctcctctgggctggaacagtttgtcagtctttatctttcataaccttgttactttcaaagaggtgctttgttgaatgtcccttaatttgagtttgtcttgttttcccatgtttggacaaagataatgccctttgttatttcttttttgacagagtctccagcctgggctggagtacagtggtgagatcatagctcactgcagccttgaactcccaggctcaagtgatcctcctgcctcagcctctcaagtagctgggaccacaggtgcatgccaccacacctggctagttttttactttttagagatggggtcttgattgttgcccaggctagataatgcatttttgacattaaatccccccaaaatggtgttgcatccctcccagagcatcctatcgtggggtttatgatactgacctgtcttttactggtgatgacggtcatgatcatttgctaaagtggtgtctgccaggatttttctcctctaaacaggtgctatgagaacctgctttttttttttttttttttttttttttttttttgagactgagtttctctctgttgcccaggctggagtgcagtggtgcgatctcggctcactgcaacctctgctgcccgaggttcaagtgattctcctgcctcagcctcccaagtagctgggattacaggcgcctgccaccatgcctggctaatttttgtagttttagtagagacaggattttgccatcttggccaggctcgtgttgaactcctgacctcgcgatccacccaccttggcctcccaaagtgctgagattataggcgtgagccactgcacccagccattttttttttttttttttgagatggagtcttgctctgttgtccaggctggagtgcagtggcacggtctcagcaacctccacctcctgggttcaagtgattctcctgcctcagcctactgaatagctgggactacagctgtgtgccagcatgcccagctaattttttatatttttagtagagatggggtttcaccgtgttaggatggtatcaatctcctgaccttgtgatccacctgcctcagcctcccaaagtgctgggatttcaggcgtgagccaccacgcctggcctgagagcctgcattttgatgacactagtgagtgtaaaatatctttttttttctttttattttctttattcacaacaggtatgaaatgattgttttcagagtcttttttttttttttgagacagggtctcactctgtcgcccaggctggactgcagtgatgtggtcatggctcactgcagcctcaacctcctgggttcaagccatcctcctgcttcagcctcccaagtacaggtgcgcaccaccacacttggcagacttttaaaaatttttttggagatggagtctcactatgttgcccaggctggtctcaaactcctggcctcaagtgatcctcccacctcatcctcccaaagtgctgggattactggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccagggagcgtccctgccactgtgcccatgcagatgccaaagcccagcagagtccagcaggcgctcgcaggtaggtgcctgccctcgggctgcagagcagtctgtgccctgcgggacttggtggggaggaaattgtgatgtggggccttgtcaccctctggatcctcagggagagccagaggggctccctgggggagcagtgcctctttctggtgatggtgtcaccccagagtgagcccaggtgcccctccttttgctctctgggtacgtgggcctgatgacggtgggcgctcgggtgcagaccttttcacatcctttaacatttttgcattgaattgcattatatttaaatagtcactttcctgtcctgaaatactttaaacatttccttaaaggggccctctggggaattaatagatctatttcggctgtagttactcttacatcttgaataagaggcaccttttgggtccaaccagatcttttgctgtactaaccatacatcttacatcttggaactgttttgggtttggtttggttttttgtgagacaagagtctcgctctgtcacccaggctggagtgcagtggcgctaacccagctcactgaagtcttgaactcctgggctcaagcaatcctttcaccttaaggatccttaaaaatacctactgctggcccccacacccattctgttttagcagcctggctagcagggttttcagaagctccacaggtggcaggattttttttcttttttctttttttgagatggagtctctctcgcccaggctggagtgcagtggtgggatctcggctcactgcaacctctgcctcccaggttcaagcaattctcctgcctcagcctcccgagtagctgggattacaggtgcatgccaccacgcccgggcaatttttgtatttttagtagagatggggtttcgccatgttgaccagtctggtcttgaactcctgacctcaagtgatccatccgcctcggcctcccaaagtgctgggattacaggcatgagccaccgtgcctggccattttttttttcttgttataagtgacaggatcttgctctgttccccaggctggtgtgcagtggtgtagtcatagctcactgcagcctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctgccacgcccagctgaggttattttctaacttctggaaagttcgaggtatgtaaggaggtggatggcgccatcgttgttcacagggtgatgtggcggaattcaataatgagttggtgttttaggggagttgctgtcgtagtggctgagaggggacaggcctggaggtagggcggctggtgcagagcctgacctcagacctgggggcaccagccaaggcctgaccagcttcgaggcagtggagttgagggggaggtttggcttgaaacattcagaggcatgagccgtcaggcggggggttgtgaggggggattgggggtagactgaggcctgctggagtgcagccagtgacaactgaggagcagcctggggcttggcgtgtgtgaattcatttcgtccttaaatcactgaggtggaggcttttgttcccattttcattagaggaaactgaggctcggagaatttaaaaattctctgccagcccttggcagagctgagacacagccccgggccttcttgcctatgacggttcagtgctgctgagtctagggggaggttgggagggggtgatggctgtggagtggccgttggagctgttccggggcagtgggatttggctgtgggcctcagaagagcagtcttgggtggaatggggtgcccctgacccctcgtgggagcgtgtgtgccacagagaccgtgggcgggactgaagagaaaatgaaggagcggccagagaggtgggggcaggagggagaggagctggagcggggcaggggagacagaatgagcaagacacactggccagaaagtccctgctcactgaagtcaccgtgcggcgccgtagggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctgagtgccctgggtgtggagttagcacctgcccccttcctctgctcttgaggctgaaggtcctgtccaggctgtgtcccaaattgtccatcctgttgtctgtccccgttgctctcagagcaatcctggagctaaagcaggtattttaacatccattttacttgtggggaaatagattcgggaagctggttcaggcctaaggaaataggagagcctggaggctgtgtggactcctgcctcccccaattcaaggcccagtgttggtacctactgggggagcattgtctaggggagcagggaatgagaggagcctggccagcaccccggagccagagctggagagcagtgtcctgtcaccctggtgtgcttgtgggttgaggaattataccatgcccggctgcggagatgagcgtttgcgcacagggtttttgcagggaggtttataaccaggaggtcatgctttggaaggactgagtgctggaggcactgcttccaagtgacagtgcctccaggtgacagctcccctggctgtggcatagcccagtccctctatcgggtgggggcagggactgtgaggctggagccagggtctccacccctcacctggtcacagcagcggtccatccacagctcacactgctgcctggggcagggatgggtgtcagcagcctgcccaggactgctcagctggtgagggctggcactgggctcgaacccaggctggggaggtcagagcgcacagaggagaggcttggatctcagccctggccctgggtgtcagaaggaggggtgtctgcaaattggaagtgagaatcagtgagtgggggcttcactcttcagggctctgacagcgggaatcctcccagatgggtggagaaaaaggctgtggccctccgagttattcaggtgatttgggggctgtcaggagtttggggggttgtccctagccctcctcctctccaggcttctgggttgaaacttgtgtgtttgtgacttgaattcaggggagtgggtcctgcattgaaaaggacacgtgtgtcactcatgcggcctcctgggggctggtggtggcccaaggatgtcttcattcctcagcaaacacagagggctgcaggcttcccagggatcaggcactgccccagcggggtgctggagatgcagctacgggtgggacctcgtggaactcgtgctgagggaagacagtccatagaaacagaggggagtgcaaagcaggagtccagtacggcggggcgggaggcttggagggacaggccccgtcaggcagtgttcagggaaggcctgcccgccgaggcagtgttgccggagaaccctgggtagggagacgtgtcctggcctttggtcctcccagacgacgtgggcagcgcagaggcaccaggttctcttgaggaaaattgcacctgtccctgtcctctcccatctgtctgccacccgcgcccgcttgtccttctctccacccgacattcagttcccacaggaaccgcatttgagcccaggaacaagcttgggatgttgggggcattgagctcccgggctcaaacctctgtcctctgatgcacgctttggtgtctcctgctgagcggccactgcaactcaccctgcccacctcggctctgctgcccaggctggtggctggtctccgcttctgtccccacagccaggcacatgtgccgggttgagaagctttgttcttctagtgggggcgcagtggctggcctggccgcccttcacccctgagtcacgccatctgttcctggatggggagtggggtccaggaggactgggatctctaccaactcccccggcagccggctgtgcccagctcctgagccaggttctgcagaccctggaagccaccttaagggatggctaagaagctctgggcttcccctttctctggagaggaggtgcttttgacctaactgaccgatgacagggaggaccggggagctggcactatggaaagtggggtaggccgagggtgtggcaggaacgggttcgtccagcaggacacgctgtgtcccaggaagcgctgggtcatcagggagcacgaaggaagcagtgtcagaggagagtcccccagggcaagtgtggggttccctgcaggcatccggcagtggtgagctctggaaagagtggccggtctgtcccagcatagctgctggccacaggcccacccttgcccgagggcgccagagccacagcctggggccttgctgcagcccagccctcacagtatggggatgctgcagtgtgggagcaggcccaggggccacgttcctgcccgcctaccccagcgctgtcgctgaaggccctggcacccagatcagccaggaggggcatggagcacacacagcgcccagtggaggctggaggcctagtaactccaagccaggagggcccagggcctcctggggaagctgagcccttggagccagccccacccaggagaccccgtgccccgggcggcttcctggagtggcgtcctccgccctctgctctcctgaagtcacgggtcctgccccggtgcccacctgcacactgagggcacgggcttgtctgttgctcctatagaaacctgtgggctctggggccagggctaccatgagccaggctgccccaccctctgattcctggcctgggtagtccccagggagacctgtgcgtccccgtggccattgatggtgtcacatccttggcctgagcagggtttgttggcgtcacatgccgaaggagtcttctaatgtctctccctctctgcgtgtctgctctcacgcccgtgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggtagttcttgttcccaaaagctctctggcctttgctaagcctccttccggcctcgctgcctccgactcttctgcacagaccctcttccttctctctgctccctgactcctgggggaaggggctcagtggcccttctccctgcccccgctcggcagcagaggcggcccctggaagctgactttccaccgcagccccagagttcagctcctctcctccagtcacagctggcatgagggggcttgttcttgaggactttgtgatttttgtaagcagcaagttgtgggtgagaggcggcgcccggctcaggatgcggggacaaccgtcccttccgccagggccagcacgtgtctcgggaaaggcccccagacagcggcccaggtctgctgcccaggtctgctgccctgacccccagccctgtgtggccgccacgtgggctgcttgagaggggtccctcggtgacccctgccctgctcgttgcatggccacagaagaaggggctttaggaccacagcaggtccagggagttacagcaagacctgctcggagcagcctgtgatggtcaagttctgaacctttcccaagcgggtgctggccctgcttccacccctgggctgtggaagtgtggactgtggccagtccagatgctcttgagtgggcgtggtggcgggcagggagggtggccgtggccctgctggccctcagtgtctgtgtcatctcagcaggtcctctcggagcctccgcttagcagaggggcttggcgaggtctaggaaatactcgaagcgcctggcatgcggcaagggtggcttccgatcgtgtccgacctccagcccacaggcgaggaggtgggctcagggaggggtgggcctcgagctcctgcccccagcccagggctctgcacgccctgcccttcccctgccctgggggaggagccagactcgttggcagcccggctggcaaccttctgtggcactcgggtttacctgggaaggacacgctcttggtgggtcgcctggctggccccttctgagacacgtggctaatggaaagctcccttctgttctgaaaagctgcaagggctggggtgggtgggcgggggtgggatgctgtgcccggcctcaccagggctgggcagaggcgaggcccaggctcacccggagatggctctggagttggcaggcttttccaaaggaaaaggcccccctcagcctgagtagggcattccagccacacggagggtgaccctgagctgggggccatcgttctggtctggcgttctcgccaccgtgacaggatttgggttcgggcagtctgtatgggtgtgtggaggtgtgggggtgtgtgaggtgtgtggaggtgggtgtgtggggtgtgtagaggtgagggtgtgtggggtgtgtggaggtgagggtgtgtggggtgtgtggaggtgtggggtgtatggaggtgtggagtgtgtgtggaggtgtgtggaggtgtggggtgtatggaggtgggtgtgtggggtgtatggaggtgtgaggtgtgtggaggggtgaggtgtgtagggtgtgtagaagtgtgtggggtgtgaggtggggtgtgaggtgtgtggaggtgggtgtgtggagctgtgtgtggtgtgtggaggtgtgaggtgtgtggaggtgtggggtgtgtggagctgtgtggggtgtatggaggtgtagggtgtgaggaggtgtggaggtgtgtggtgtgtggaggtgtggggtgtgtggaggtgtggggtgtgtggagctgtgtggggtgtatggaggtgtaggctgtgaggaggtgtggggtgtgtgaaggtgtggggtgtgtggaggtgtggggtgtgtggaggtgtgggatgtgtggggtgtgtggaggtgggtgtgtggggtgtggagatgtgtgaggtgtggaggtgtgtggtgtgtggaggtgtggagtgtggggtctgtgaaggtgtgaggggtgtgtggaggtgtgggagttgtgtggcgatgtgtgtggggtgtgtgtgtggaggttggtgtgtggaggtgtgtggtatgtggaggtggggatgtggggtgtgtagaggtgagggtgtgtggggtgtgtggaggtgcgtggggtgtgtggggggtgtggaggtatgcggtgtgtggaggtgggtggtggtgtgtggggtgtctggaggtgtgtggggtgtgtggtgtgtggaggtgtggggtgtgtgtggtgtgtgtggacgtgtggtgtgtgtgtggagatgtgtggtgtgtggaggtgtggggtgtgtacaggtgtggggtatgtggagatggggtgtgcaggtgtgtggaagtgtgcaggtgtggaggtgtgcaggtgtgtgggtatgtgcaggtgtggggtgtgtggtatgtggtgtgtgcaggtgtgggtatgtggaggtgtggggtgtgtggaggtgtgtgatatgaggagtggggtgtggaggtgtggggtatgtggagatggtgtgtggaagtgtgtggtgtgtgcaggtgtgggggtgtggaggtgtggggtgtgtggaggtgtggagtgtggggtgtgtggagttgtgaggtgtgggtggagttggtgtgtggtgtgggatgtgtggaggtgggtgtgtggaggtgtgtgggatgtggaggtgtggggtgtttggaggtgtgtgggatgaggtgtggggtgtgtggaggtgtgggatatgcggggatgtgtgggaggtgtgggtggagttggctgtgcgtgggggggtgtgggtgtggattggggtgtgtggtgtgtgtataggtgtggtgtctttaggtgcggggggtgtggattggggtgtggtgtgtgtaggtgtgtctgtaggtgggggtgtgggtgttggtgtgtgtgtggaggtgtggggtatgtgggggtgtgtggaggtgggggtgtgggtgttgtgtggggtgtgtgtggggtgtgtggaggtgtggggtatgcggggatgtgtggaggtgtggggttgtgggtggagttgggtgtgtgggtgtggaatggagtgtgtggtgtgtgtataggtgtggtgtctttaggtgtggggggtgtggattggggtgtggtgtgtgtgtaggtgtgtctgtaggtgggggtgtgggtgttggtgtgtgtgtggaggtgggtatgtgggggtgtgtggaggtgagggtgtgggtgttgtgtggggtgtgtgtggggtgtgtggaggtgggtatgggggtgtgtggaggtgtgggggtgtgggtggagttgtgtggggtgtgtggaggtgtggggtatgtgggggtgtaggtggagttgggtgtgtgtgggggggtgtgggtgtggattggggtgtgtggtgtgtgtgtaggtgtggtgtctaggtgtgggggctgtgggtgtggattggggtgtgtgtgtgtaggtgtgtctgtaggtgtggggggtgtgggtggaggtgtggggtgtgtggatgggggttggggggtgtggtcttgccagcagtttccctccaggtcacagcagccatgccatcacagcaattccagcttggttacatattcgtctttcccgtttgagatcagggaaccgaggctcagaggtggcatgattcgttcacagcaagagaactagaattaaacaaactgtgccgactccagcctccgccccaccacgccacctccctgccaaactgtcccctccctggccctttttggtgtaaagggagttcagcaggtgcagctgtgcgccctcaggcttagaggcttagaattctctgcagcacctaaaggccgtgagcttggattcaaaccagagccccttctggtcctggagtctgggacgaccgcagccccaccatgaccttggggtggagcccctgtcaggagcgcctccacgggtggcactgggctccccgtccctctttcacccccgcacgggcttggctgctggcttctgtggttctgctactcccactacctagagaacgccccgggccgcgccgatcctcaccagctcaggagcttcttgtccgtaggagaggctttactggatgtggggttcggtgtttatggagatgcagcccttctccctccagcttcgtgcgtgtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggaccccagactcccttgtccttgcgatgttcatgccagggtaatgcaagttgaatcaaatcgtggtgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaacaactccacatggaaaggacatccgccccatcttgcttgaagggtgcttcccaggtgcctctgggtgccagggccttgctccagcccctttggtttcatctcccagcctcccgagacccacatcgttatgatctgagctttgcacttaaggagctgtggtcctgagcaaagcccctcctctcccggccctggcctctccatagcctgatggccatcctgggagcaggaattccagagacaagggatgggccagcctgccccactctccaccttgcggatgctggtgtagaagtgaggtggcctcgtccaggtggctgtcctgtcccccggctattgggagagctggtcaaggttcttataatttttttattcttaaagacgggtgcacactgtcacccaggctcagtgcagtggcgtgatcacagctcactgcagccctgtcctcctgacctcctgtaatgaacaggaccaatcagactcctattgcgcttccatagaacctgaacctctgctgagccacgttttgggggctgcagcaccactttcccctgattttagctgggagcccgggagatactgttgggggagggggtgggcgaacggccgggagtaccagtacccagagatcttcagatacttgggggcgggtggaaggccaggagccccagtacccagggactcttcacttgtctctttctccagtctgagtccatgagaaaaatttggtaagtaaaggtttggaaaggagcctgaacgtcgtcctcatgtgtcccaccccttccacaagcccttgccacattcccgcctgcccagcgctcagctctgtctcggccctggtgtccatctggtgtgactgggccgtttcaccccaggctcctcctctccaagctgccgtctgcacagccagcacgcagcttggatcatgggagcactccctgcctggaacccccagcaggacccccaactcacacacaaccccaagcccctgagtgtggcagccagacccccgagggcgcgcctctccctgatcctgtctcatctcctgctcccagcccaccccctgccagctttagtgcccatgcgctggctcctcgttcagaacgtcctcctccctcttccgggtgcccactctgtgcttgtccatctggcaattcctgtctcccttgtaagaccccactccgagggcctcccccaggatcctgccctgtccgtccttcccatttggtggcttctgctgtcatgtcgggcctgtgctgctggtaagcccttcaagggcacaggtcccggtgactcacctgtgtctccagcctgtggaatggactttttttttttttttctgagacggagtctcgctctgtcgcccaggctggagtgcagtggcataatctcagctctgcaacctctgccccctgagttcaagtgattctcttgcctcagcctcccgagtagctgggattataggcgcctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctcttttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaactgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcaccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatggcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattcccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctttccatggcccgtgtcaatgccggtatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgtattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcacctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctgtacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccttgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagggctatctgagagcggttcttcctggccctcgggttcaagcaacggcataactggaaccgacggttacggaccaagggtatgcgagagcgggtcttcccatacaggaagtagaagatgttttgtttggggtcctcgtcgtcctcctccatgtcattggccaggtagctgaggacagaaatcaggttggtgctcaggggcaccaccaggagaggcctccggctgaggtcagcttcccagagaggaaggtaagggactgtccctagctcaggactggcacccaccctgcagagagccacgccttcctcaggagggctctgctggacagagacctgatcaagggcgtctcccactccttcaggatggagacaaaagcccaactggtggccgagagtggtggcttatgcctggaatcccagcacactgggaggccaaagcaggaggatcacttgaggccaggagtttgagacgggcctgggcaacatagcaagaccctcgtctctattaaaaatataagaaatatgccagacgcggtggctcatgcctgtaatcccagcactttagaatgctgaagcaggtggatcgcttgagaccaggagttggagaccagcctggtcaacacggagaaaccccatctctactaaaaatacaaaaatcagcctggtgcggtggcacacccgttaggcctagctactcaggaggctgaagcataagaattgtgtgaacccaggaggcggaggttgcagtgagtcgagattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtctcaaaaaaataaaagaaattgaatacattgatattttgccaggaccctgccttctacaggcatctagtctaatgggactggcagtaaccaaggcagatgagctaatcccagtgtccaggatgtaactagagagctacgggcatgcagaagttggaagatgagggaaggcatcacagaggctgtggggtgaactgacttcaaggaatgggtccttcccttcagagccacatgtgtgcgggacacccagacagaaaacacaaacacaaagtcgagtggagggcatttggaagaagcagtgaagccgagccaggaaataccaagatggcgagccagtgtgcttgtagagattgtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcagggagcatttgacagtggattcgagtgatgcgagggggacctgaactgtggcctctgtcatgggaacccagaggaggtcgatggcgtttgtggttgatgtgggaaggagagagagagagaagaaccagaaacgtctgcttgctggaggaagcggcatgtccgctcctccactccttttcttttccccttaggagcggtttatggttccttttgttttattcttttatttgtacactggcattggagtttgtttttttggcttttttttttttttttgagaaaaagtctcactctgtcacccaggctggagtgcagtggctcgaccttaacttactgcaacctccacctcctgggttcaaagggttctcttgcctcagcctcccaagtagctgggattacagatgcacaccaccacgcccagctaatttttctatttttagtagagacggggtttggccatgttggccaggctggtctcgaactgctgacctcaggtgatctgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggaagcaaaccactcacagagccaggaagaaatgaatgcgttggtattgccaggaggggaggccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatctgagaagccagaggaagggttttgggtgatgctcccaggatggtgggctccgatgggatctttggagggggtgtgtctaggtcggctggtgtcaggagggtcttttgtgtgccaggcagagaactgtcccaaggagctgagagtagaggggccaggagcttcagggctgcagccagactgtggcccagggctcagatcccaaaggacccataggagaggcaggggccactcattcactctgcaagagaccagcagaatcctgagggagatgctgacaaatcataaaaagaccaagaatagccgggagtggtggctcaagcctgtgatcccagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccgggaggcatcggctgcagtgagtcaagatcgagacactgccctccagcctgggcaacagagcaagactctgtctcacaaaaaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacatcagggtgtgaccatggccttgggatcccccactatggatggagacacttaggtttagaaaagtcagtaagagactttaagtttcagagggcacagctgaaaccactttctttgtttattgattttgtttttcttgatttttatttttatttatttattaatttattttgagacagagtcttgctctgtgggccaggctggaatgcagtggcctgatcttggctcgctgcaacctctgcctcctgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtctctttttttttttttttttttttgttgttgttgttgagaaacagtcttgctttgtggcctaggctggagtgtagtggtgcgatcttggctcactggaacctccgcctcctgggttccagtgattctcctgcctaagcctcccaagtagctgggattacaggtgcccaccagaacacccagctcatttttgtgcttctagaagagacagggtttcaccatgttggccaggctggtctccaactcctggcctcaagtgatctgcctgcctggcctcccaaagtgctgggattacaggtgtgagccactgcaccctgcctcagtacctccattcttcccacacaccctcctcacgtgctccttcctgacttctgggcccttccttccttctttttttttttttttttttttttgagacagcgtctcactctctcacccagaatggaatgcagtggcgctatcttggctcaaagcaacctcttccacctgggttcaagcgattatcctgtctcagcctcccgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccagcgtgctaggatctcaggcgtgagccactgcacctagcccgaaaccaagctttctcatcccaagcgccaacctttatcaagtctagcctagtcctctatcatctcctaagtgtccctcatgagtgatcacttctgagtcctcctgcgtggagagctcacccactgggggcgtatctttcccattgtaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccttcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctggcttctctaagccatctttctgattttctcctctgctcaaccccatgtgccgctccttcccctccccattcttctctctctctgtcctccgaacactgcttcatgtccttccctggtctctggctctctgagtccctccttttttgttttgttttgttttgacacagaatcttggtttgtcacccaggctggagtgtagtggtgcaatctcagctcactgccacatccatctcctggattccatttattcttctgcctcagcctctcaggtagctgggattacaggtgcctgccataatgcccagctcaattttgtacttttagtagagacagggtttcaccatgttggccaggctggtctcaaactcctggcctcaagtgatctgcctgtcttggcctcccaaagttctgggattacaggtgtgagccactgcacccagcctgaatttctccattcttcccacacaccctcctcaggttctccttcctgaccgctgacccttcttttcttttttcttttctttttttttttttttggagtgcagtagcgtgatctcagctcactgcaacctcttcctcccagtctcaagtgattctcctgtctcagcctcctgagtagctgggattacaggtgtgcaccactaccacttgactactttttatacttttagtagagatggggtttcaccatattggccaggctggccttgaactcctgacctcaggtgattcgcccgcctcggcctcccaaagtgctggggttacaggcgtgagccaccgcacccggcccccttccttcgtcttagtcaaccctatcccacctcttcttccaccagtcccctcacctgatggtcccaacacttcatcatccaccacctcctggagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcagttcaagaccagtataggcaacatagcaagagcccatctctaaaaaaaccaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatattgtgtcaaaaaatttttttttgataaaaaataaaagagttacatgacattcagagaccatccaaaaaacctgtgggttcccggctgggctcagtggctcatgcctgtaatcccagcactttgggaggccacagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatcgcaccattgtgctccagcctgggcaacaagagcaaaactccatctcaaaaaaaataacctgcgagtgagttcccacacgttttcctaatgggctgctgctttcctaggagtctctcgctcatagaaaaggcacacactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctggtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttggtgacctggggctgggtgggcctctgagagcctttatagctgattgccttttgggagagggcaggtgggagccccaccctgtctcatgagtcaccccaaaggtgcatgggcaggcaggtgctggggaatcggctactccccagagcttggcgtggccatccctctggcccctctgggagtctggagcccattccctcacactggtactcactgcagctggggacatctgcactaggaagacaggacacggcatggaagctggcctctgcccagaagccatgacattctggtcaccagcctgatgttataaaacgagtgtcatggccgggcatggtggctcacacctgtaatcccagcactttaggaggccaaggcgggtggatcatgaggtctggagttcgagaccagccgggccaacatagtgaaatcccgtctctactaaaaataagaacattagccaggtgtggtggcacatacctgtagtcccagctcctctggaggctgaggcaggagaatcacttaaacccaggaggcagagattgcagtgagccgagacgacggcattggactccaggctgggcaacagagcatgactccgtctcaaaaacaaacaaacaaaaaaaacgagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagatcagcctgggcaacatagcgagcaccccatctccagaaaaaatttaaaaattggctgggcgcagtggctcatgcctgtgatcccagcactttgggaggccgagggggatggatcatttgaggtcaggagtttgagaccagcctggccaacatggtgaaaccccgtctctactaaaaatacaaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaacctcccccaaccaccctcagctcaagcaattctcatgcctcaaccctcagcctcatgagtaactgggactacaggcgtgcaccaccatgcccagctaatttttgtatttttagtagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctggatagccccctacccacatgcctcagcattgggaggtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtcgactaatgacccttgtccctcccctcagctgcctctcttttttctttttttttgcttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcgaactcccgacctcaggtgatccgcccgcctcagcctcccaaagtgctgggattacaggcatgagtcagcgcacgcagcccatcttaagctttttttttttttttttttttgacgaggtctctctctgtcattcaggctggagtacagtggtgccatctcagctcactgcaacctccacctcccaggttcaagcgattctccccgcctcagcctcctgaatagctaggactacaggcgtgcaccaccacgcccagctaatttttatatttttagtagagacagagttttaccacgttggccaggctggtctcaaactcctgacctcaggcgatccatgcacctcggcctcccaaagtgctgggattccaggcttgagccaccgcccctggcccatcttcactatttttaagtggacagcacagtagtattaactatatgcacatcgttgtgcaatagatctctggaactttttcaccttgcaatactgaaaccctacactcaacaaacaactcgctttccctgccccgctccagcccctgaaaacttctactctcctttctgcttctgtgaattgtactattccagatacctcccataggttgaagcaaccactatttgtctttctttgtaactggctcatttcacttagcattatgtcttcaggtttcatccatcttttagcatgtgtaagaatttccttccttgctttgtttgtttgtttgtttgtttgttgagactgagtttcactcttgtcacccaggcttagagtgcaatggtgcgaacttggctcactgcaacctctgcctcccgggttctcttgcctcagcctccagagtagctgggattacaggcgcctgccaccatgcccggctaatttttgtatttttagtagatatggggtttcaccatgttggccaggctggtctcgaactcctgaccgcaggtgatccacccacctcggcctcccaaagtgctgggattacaggtgtgagccaccacgcctggccttgtttttgtttttgtttttggagacagagttttgctctgtcgcccacgctggagtgcagtggtccgatcatacctcactgcagcctcccctcctaggctcaagcaatcttcctgcctcggctttctgagtagctcaaactacagacacacactggtcatgaaatccttgcctaagccaatgtctagaagggtttttctaatgttatcttctagaatttgtacagtttcaggtcttagatttaagtctttaatccatcttgagttgatttttgtataaggtgagagatgaggatccagtttcattctcttacatgtggctagccagttatcccagcactatttgttgaaaagggtgtcctttccccactttatgtttttgtttgctttctcgaagatcagttggctgtgtttgggtttatttctgggttctctattctgttccattggtctatgcgcctattattataccagtaccatgctgttttggtgatgatggccttaaagtatagtttgaagtcaggtaatatgatgcctccacatttgttctttttgcttagtcttgctttggctatgggactcttttttggttccatatgaattttagaattgttttctctaactctgtgaagaatgatggtggttttttgatggggattgtgttgaatttgtagattgcttttggcagtatggtcattttcacaatattgattctacccatccatgagcatgggatgtgtttccatttgtttgtgtcatctatgatttgtttcagcagtgttttgtagttttcctcatagaggtctttcacctccttggctaggtatattcctaagtacttcatttttttttgcagctattgtaaaaggggttgagttcttgatttgattctctgcttggttgctgttggtgtttagaagagctactgatttgtgtacattaattttgtatctggaaactttgctaatccttttatcagttctaggagctttctataggagtctttagggtttttgaggtaaacaatcacatcatcagcaaacagtgacagtatgacttcctctttaccaatttggataccctttatttccttctcttgtctgactgctctggctaggactttcagtactgtgttgaagaggagtggtgagagagggcatccttgtcttgtttcatttctcagagggaatgctttcaacttttccccattcagtattatgttagctgtgggtttgtcatagatggcttttattacattgaggtatgtcccttgtatgccgattttgctgagagttttaaccataaagagatgctggattttgtctaatgctttttctgcatctattgagatgatcatgtgatttttgtttttaattctgtttatgtggtgtatcacatttattgacttgcatatgttaaaccatccctccatccctggtatgaaacccacttgatcatggtggattgtctttttgatatgttgttggattcggttagctagtattttgttaagaattttagcatctgtgttcatcagggatatcagcctgtagttttcttttttagttgtatcctttcctggttttggtattagggtgatgctggcttcatagaatgaattagggagggttccttctttctctgtcttgtggaatagtgtcaataggattggtaccaattcttctttgaatgtctggtagaattctgctatgaatcagtctggtcctggacttttttggttggtaatttttaattaccacttcaatctcctgcttgttattgatctgttcagggtatctaattcttcctgatttaagctaggaagtttgtatctttccaggaatttatccatctcttctaggttttctagtttatatgcgtaaaggtgttcatagtagccttgaatgatcttttgtatttctgcccccattttgtttcttattgaggttatttgaattttctctctttttttcttggttaatcttactaatggtctatcaattttatttatcttttcaaggaaccagcgttttgtttttatcttctgaatttttttgtttgtttcaatttcatttagttcttctctgatcttggttatttcctttcttctactgggtttgggtttggtttgttcttgtttctctagttccttgacgtgtgaccttagaatgtcagtttgtgctctttcagtctttttgatgtatgcatttagggctgtgaactttcctcttaggaggaaaggtggcctttgctgtatcccagaagttttgataggctgtgtcactattgtccttcagttcaaagaattttcaaatttccatctggattttgtttttgacccagtgatcattcaggtgcacattatttaatttccatgtatttgcatggttttgaaggttccttttggagttgatttccagttttattccactgtggtctgagagagtgcttgatataatttcaactttcttaaatttattgaggctcattttgtggcctatcgtatggtctatcttggagaaagttccatgtgctgttgaatagaatgtatcctgcagttgttggatggaatgttctgtatatatctgttaagtccatttgttccaagatatagtttaaatccattttttcttcattgactttcagtcttgatgacctgtccagtgctgtcagtggagtaatgaagtccttcactattattgtgttgctgtctgtctcatttcttaggtctattagtaactgttttataaatttgggagctccagtggtaggtgcataaatgtttgggattgtgatattttcctgttggacaaggtcttttagcattatataatgtccttctttgtctttttcttcttcttcttttttttttttttttttgagacgtagtctccctctgtggcccaggctggagtgcagtggcgtgatctcagctcactgcaacctctgcttcccgggttcaagcaattctgcctcagcctcccgagtagctgggattacaggtgcccaccaccacgcctggctaatttttatatttttagtagagacagggtttcaccatattggccagggtggtcttgaactcttgacctcaggcaatctacccgcatcggcctcccaaagtgctgggattacaggcatgagccactgcacctggcccttctagtcttttttaactgctgttgctttcaagttagtttttctgatataatagctactcctgctcgcctttggtgtccacttgcatgaaatgcctttttacacccctttaccttaagtttatgtgagtccttatgtgttaggtgagtctcttcaagcagcagatagttggttggtgaattcttatccattctgcagttcttatcttttaagtggagcatttaggccatttacattcgatgttagtattgagatatgaggtagcattccatttgtcattttatttgttgcctgtgtactttggttttttgtttttgttttttaaattgtatttttgttttataggtcctgtgagatttatgtcttaaagaggttctgttttgatgtgtttccaggatttaagatttagagctccttttagcagttcttgtagtggtggcttggtagtggtgaattctctcagcaattttttgtctgaaaaagactgtatctttcatacacaatgcctagtttcgctggatacaaaattctcggctgataattgttttgtttgagaaggctgaagatgggccccaatcccttctagcttctagggtttctgctgaaaatctgctgttaatctgataggttttcctttatcagttacctggtgcttttgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgatttattcctatggttgttctggagctaaaatgcatgacacgagcctctacacgctgctctgtccgtccgagtcagagccgcaatctagtcttttaaagggctctctccacctttaaaaacccttacctataagccatctgagagttcaagtgttaagtataatctgcctgattctccttgcttggtccctacaaacaaaggctttcccttctcttgctacaagccttggtttagatatggtatagatacatagtcttattacgctgggcgagtggacctccgtttggttcaataacaaaatctgaactgaggagagttgtgattacactattgcatttcatcataaatattttccttgttgaatccaagcacacaaagtacagaatgatcctcttcctcagtacagtttttccctctgttatactagtaccatgatatcctcagctgaagaaaaggtgctagatgctctgtaccatctgatctttttgtcaggtgcttttctgatgcaaattattctctgaattcttatctctccctttcactctgagccataatcttgtctatgtcctggagctcattgcgtttttcccagaacacagttgagtattcaaggacctcccgtaagctttttccctcttcttctcttgctatattttcaatatcacaaccccattttaattagctttgataagctggttaaaatctctgagttcaattggtaaatccctgtgttaactctatctcttcatcaataaggggttcagcttatttaaactgttctttttctgtgcctatgctgcatttggtaggtcgtgattttgaggtaccttgtacccagttgcttttctgtaatacagagtttctttttctagtaattaaaataaatgttgggccagatgcggtggctcacgtctgtaatcccagcactttgggaggtcagggtgggcagatcacctgatgtcaggagtttgagaccagcctggccaacatggtgaaaccccatctctgccaaaaatacaaaaattagctgggcgtggtggcaggtgcctgtaatcccagctacttgggaggctgaggcaggagaattgcttgaacctgggaggcagaggttgcagtgagccgagattgtgccattgcactccagcctgggcaacaatagtgaaactctgtctcaaaataaaataaataaataaaatttaaaaataaaataaaataaatgtggaggaaagaactggaaatcctgaaatttttgttttttcaactttttcttcttttttaatacaatttagcaccaataataaagcatcaataatagtaaggcttttctacatatctgagatctcttccttaatatattatttatcacctccccaataatatatttgttacttatggagtgaaaagccttcaacctatttccttttgcagcaatagaggccaagcacagtgttactgctctcaagaaaaagaacacacaagcaatttcagcttagaaacaatacttaaaagggaggacagtttataaaattccatctaggttgcttgaaaatagctttctctatcttgccaataagtaatttactgaaacttctttgtactttgacctgaatctgtggagactctattctattaataatttgtaaagtttataaattccttcctacaaaagtttttcaacatatattggaatctggggtttcaaaagccttcctccttatttacttctctttgccaattaaaatcacacactgtttctttgaccaagaaatgggaaaatgactactctatccctatacactgtggcttccactaagtgggaggaaaggcttcctaggacatgtgtttaactctgtaatttgctctcgaaactgctgccccaatgtacccaaatatatgaatctctatgttctttttatttaacccaaaatatacctgatctattctgcactaaatatcaacaacaaagacagggctccaggaagtaacttgcagaattgtcttgtttaaaaataggattaacaagcttcttggtaaggtgagctttttcctgcctccctccccactcccacttctaaccctgtaacattctttgtttatgtacatttggttcagagggatacttctgctgctgccttattattaataatagcagattaaacttcagtgcctcagggttggaggattctcttttatactacaaacactttgggccgcccactataggaagtgccatgctaagtatattagggaggttcaaaagatgtgaaaagacacaccagtgctctcacaaagcttaccaactcactaggaaaataaatcatacactatgaaacaacatgaaagtaattactctgaaattttattatttttaacacatacatttcacaaacaatacctttaacaccacatacaattccataacaaaatattttaattttgtcaacgttcttttttgtttgttttttgagatggagtctcgctgtgtcactcaggctggagtgcagtggtgcgatctcggcttactgcaacctccgcctcccaagttcaaatgattctcctccctcagcctcctgcctcagcctcccgagtagctgggactacagccgcgtgccaccacacccagctaatttttttgtatttttagtagaaatggggtttcaccatgttagccagtatggtctctatctcctgacctcatgatctgcccgcctcagcctcccaaagtgctgggattacaggcgtgagccaccgtgcccagcctcaacgttctttaactttttacaatcttctctcaacaaaagtgtaacccaagataccttgacaagaaatcttccagataaatatttttgagctagtttcaatgatgcctatccactaaattttctctcaaatacttgcaataataataaagtcaacagtactctaggcaagagtatactgaggaagtacacaattaatcagttcttcccaaaaaataatcgtaatagtttcttcctcaaatcttttcttctgcaatgtctaatctcatccattgtatttttcatctcagacactgtagttttcatttatagaaattcaattttggtcttctttttatatcttccatgtcttaagtgtttgaacaagtgcaatacagttataataacttttattttccttctctgctaattcggtcatctatatcagttttgggttagtttcaattattctcttcattataactcatgggtttttttgccctttgcatgtctgataatctttgattcaatgctagacagtgaaaccacctctgcaaaaatcataactgagaaaattattacagtgaaagagatctgacataaccagctccatcttgcttctaatcaccaagctgtccttgttcatttctaggtacaggctgaactaacttttgggaggaatttagtttatagtttagctttgaaaccaagacaataacagccatttcccaaacaaactccattcctgcctggggactagactcccttttcaggacaacaaattagccaaaagattagaaattgtggtttaggagtcatgtagctggaagctgcccaaattgctaaacctccccaaattgctcctgcggataacatcactattgtaaaacctaagatcagtgcttgaaatattttgcagaccctaaactcagtcgatcggctggcataacccagattgataagctggctcatctggtcttgtggcccccagtcaggaactgactcaacacaaaaggacagctctgactccctatgatttcatctcagactgactaatcaaaactcctaactcactggccccctatcaaattatccttaaaaactcagatcgtcagattctcagggagactgatttaagtaataataaaactggtctcctgcatagccagctctgcgtgaatttctctttctctactgcaattcccgtcttgataagttggctctttctaggcagtgggcaaggtgaacctgttggatgggttacaacattgtgaattttactttgttgggtgctggatatttttgtattcctgtaaatcttgagctttgctcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactccatcttgatctccctaactcagggagtgttctagactccagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttcttttcaccctcttttttaacttattttgaaataatttcatactgacaagttacaaaaacagtagagagaggttctgtatacccatcactcagttcccctaatggtgacagcttctataagtatactgcactatcaaaaccaggaaattagctggcaaattaactggactatagaccttactcagatttcaccagtttttacatgcattcatttttcgggtatgtctttgtatatactcatgacattttatctatcacatatatagcttcatatataaccatcattttaatcaagatatggaactgttctgtcactacaaaggaagtcccttgtcatgtccctttaaagtcatactctccttctccttccctaacctatggcaaccacttgtctattctctacatctttaattttgtcgtttcaacaatgttatataaatggaatcatagagtatggaccattttgagattggcttttttcactcagaataatgcccttaaattcccttcaagttgtttacatcaacagattgttccctttgtcggtgaattaccttatgtggacataccatgagtcatatgaacattcagtaatggaaggatatttaagtcatttccagttttttggctattacaaataaagctgtgaacatttgtgtacaggtttttgtgtgaacataagttacatttccccaggataaatgcccaggaatataaatgctaggtgattaatggtagtttctttttttttctatttttttaagaaactgccagactgagttatagagtagctgtatcattttacattcccaccagtaatgtagaagagatccagtttctctgcacacttgccagcatttgaataatcagtatttttaatttttgccattctagtaagtatgtagtattttattctggttttaatgtgcatttccctaatggctagtgatgttaatatctttttgtgtatttatttgccatcatatatcttctatggttgcactgtttcttaaaagttacaagattaaacttctgtgtgcacgaatcatgttttcttcactactggggatagttcacttaggataaggatttggctatggtttaatatttcttgaatgaccaaaataaatacaaagacaataataaaacaaaaccccacaggcatcacaaacagaactcataatgctctgagattggggcctgcactttgaactctagtctagggatcagcaaactatagctcacgggccaaatctggccaggggcctgtttttgtatgccctgaaagctaagaagggcttttactttttttttttttgagacggagtctctgtcacccaggctggagtccagtggcatgatctcggctcactgcaatctctgcctcctgggttcaagcaattctccctgccttagcctcccgagtagctgggatttcaggcacccgccaccacacccagctaatttttgtatgtttagtagagacagggtttcgccatgttggccaggctggtctctaactcctgaccttaggtgatccatgcacctcggcctcccaaagtgctgggattacaggcgtgagcgaccgtgcccggccgggcttttacatttttaaagggttatttaaaaacaaaaaaatatatgcaacagagtccatatgtaatctgctaagtctaacatatttactatatggtgtttacagataaagtttgcagatgaatggaaagaaaacctgatcttcttttttggggcaaacattaacaacattgacatctgattacccatgatactctcaagatcttattctttaacaaaaaggtggggaaataaaaacaccataaaagcggccgggtgcagtggctcacgcctgtaatcccagcactttgggaggccgaggtgggcggatcatgaggtcaggaggtgagaccagcctggccaatatggtgaaaccctgtctctactaaaaatacaaaaattagccgggcgtggtggcgggcgcctgtagtcccagctactcaggaggctgaggcagaagaacccctggaacccgggaggcagaggttgcagtgagccgagatggcgccactgcactccagcctgggtgatagagagagactccgtctcaaaaaaaaaaaaaaaaaccataaaagcactatgacgtgaaaacagttcctacattaactccctgtcaaagtacttttaagcagatagctataagccttagagcattcttcattctgttattgaatttcttccatctggtcctgaaatatatatacattgctgacaaattcatgtgctataagctttgaaaaaccaaaaactttagtgggttctaaaatcagagctatttccaagagtcagtcacatcaaaagactggatttttcccaatttggagagaaaacagtgtctctagatttttaaagtggcatcttatgagcttagtcccatttcaacctcttttccaacccatgaacgagtattccactataaataacaattccattgtatgttattaccctctgtcctttagacaagctaagaactcttttctgacttggtggtttatttttatcccaaatgaatttatgttgtatatgctttatatttccagttttactaaaatgaggtaaacccagtagtgctagcttccctactatccagacaatgacaaacaccaatccgttcactggcaacgcactttacctctaatattctttgaacatttaaacatctaaattgtggagttgtaaagaccaaaggactttgtacaacatgcatacctgggcttggagacttgatgtttaccacagtcaagtttcatatctaagttgatgaaccaagtctaaaacctaatagagaagccaacttattagaagcatcttacctaagccactcacaacatgttaaatttgccacacatgggtagaggacaaaacttagaatcaagactctcatgaagattatagaatgcagccccaatacacacttgtgcatagctttttagtaggtaaatgtttcagcctgagagtctcaggtttccttttgacctcagaatagcacataatacgtgtaaatcatggtaggaattatacacctgagtttatttatcagtgacagcaatagcaaaggaaaccatggagcaggaaatcaaataaaattatagagctgacacatcaaaaccctgtgggaagctggaacctaagggaataattttactggcatggcttcttgcagagattatccagaagtcatgctgcagataaaatccaggctcttagcaataagagtatttctatttttatccctcatgggctctatgaggaaggccaagatgagctgagctcagctgcctataataatagctcacatataaagctgcttattatttccaaaatttggtttcagattggaaatctccatagaaaaaagcaatctgccctgattttctaggcctcttaaattatttcatccagttgatacataaggcctgtggctgactgggtaccaaacagttttaaaaccaaaatgaaatatggaagtttctcttaaacccaatcacctgttcatactcacagctccctccagagactgctgctctcttcacctgaggtccattattactttaatggatttaatttgctatcagagacaacatacagatccatctggggaccaacctcatagggtagtctgtgctactctgcaaaacgatgcttgatcagtacctagattcttccaccgtgaacaggaaataaactcatcattctgcgatttggcccttcctgcttcaggaggtggggccggagtataagccataataacaagtaacacacaaaaagaactcagtaggctaaggcgcttcataataaccaatgaggtaagcatgcatcttcctcatagcattcattcatctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatagtttggccatatttgactcctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaagaggtaggctaggggaagataattttgtttttaaacattaagttttaggtggcactggtttagtggaatagaaatgcacaagaacaatagagatcaggtctgcatgtattgacttggaagttatgtacatagaaataatgactgaagttgtgagaatagttttaaaacaatctaaattttagaaaggcatatgattccatgaataaatgaataaaaatatgacaaaatagctttagcttataattcaaacatgcttacatatgccaataattttggttatgctatgattcagagcacagttaaacaaacttgtattattgttttagattattgggaccaaaaataggtaactctcttggctccttatcaaattcaagcattagatcacaagttgattctcactatatttgatacccagtcacacactgcataattatgtttcagtcaacgatgaactacagaaatgatggttgtcccataagattataatagaggtaaaaaactcctatcacctagtgacttcgtagccatcctaatggttgtttaaatgcaatgcactacctgcatttgtggtgatgctggtgtaaacaaacccactccactgtcataaaaaagtatagcacatatgttatgtgtagttcataatacttgataatgagaataaatgaccgtgttactgatttatgtatttactatactttttatcgttagagtgtatatcttctgcttattaaaaaaaaaaaaaaaagttacgatacaacagcctcaggcaagtccttcaggaagtattccagaagaaggcattatcatcacaggagatgacagctccacgtgtgttattgcccctgaaggcctttcagtgggacaagatgtggaggtgaaagtgatactgacattctttacccagtaaaagcctagactaatgtgtgtgtttgtgtcttcgtttttaacaaagtttaaaaagtaaaatttaaaaaaattaacaattttaaaaacagaaaaaagcttacagaataaagatagacaagtatatctctacagctgtaaagtgtgtttgtgtttcaagctaagtattattacaaaagagtcaaaaagttttttattttattttatttttttctgagagggagtctcgctcttgctcagactggagggcagtggcgcgatattggctcattgcaccctctgcctcctggtttcaagggattctttttcctcagcctcctgagtagctgagattacaggcgcccgccaccacgcccggctaatttttgtattttagtagaaatgggggtttcaccatgttggtcacgctggtctggaactcctgacctcaaacgatctgcccacctcggcctcccaaagtgctgggattacaggcgtaagccaccgtgcccagcctcaaaaaattttttaaaatgtaagtttataaagtaaaaatgttctttgggaagttgaggtgggaggatcacttaaggccaggagctgaagacaagcctgggaaacatagcaaggccttgtctctgctaaaaactttttaaaaattagctgggcatggtagtgcacacctgcaacctagctactagggaggctgaggcagaaggatcacttgagcccagagtttgagtttatagtgagctataattgcactccagtctatgcaacagagaaagcagctatctctagaataaataaagtaaaaaagttacagtaaactaaggctaatttattattgaagaaacttaaaaataaatttagtgtagcctaactgtacagtgtttataaagtctatagtagtaatgtcctaggccttcacatgcactcaccactcatcatactgactcactcagagcaacttccagtcctacaagctccacttatggtaagtgccctatacaggcgtaccatgttttatcttttataccagatttttactgtaccttttctatatatagatatacaaataccattgtgttacaattccctacagttttcagtacagtagcctgctgtacagggtgtagcctaggaataataggctactacacagcctcagtgtatagtaggctgtaccatctaggtttgtataagttcactctataatgttcacatgacaacaaaattgcctaataacacatttctcagaatgtatctctgtcattaagtgatgcatgactgtacttagattttcatcaaatttttgccacttaactatgggtttgcccattaagtggcatgcagttatatctgggagtgtataggtattatttttattcctgttatgttttttgttaatattctatgaattttaacagacaactttcttaattttcacgacatataaaatgaatacctaaaactgaaatttgatcttatgaagaccaccctcccctactccccaattcttcctttttctagttggcatctcatggatttagcttgtagcattcatccctatacacggtctaattgcaatgtcctccttgatgccattctggtaaaatttaaaggaaaacttcaccagcattaatttttttattcattaaaacaacaaaccttggccaggtgcagtggctcatgcctataatcccagcactttgggaggctgaggtgggctgatcacctgaggtcaggaatttgagagtagcctggccaacatggtaaaaccctgtctctattaaaaatacaaaaaaaattagccaggcatggtggtgcatgcctgtagtcccagctactcaggagggtgaggcaacagaatcgtttgaacccgggaggcggaggttgcagtgagccaaggtcacgccactgcactccagtatgggcaatagagtaagactctgtctcaaacaacaaaaaaaccaaccaatgacaaaccttaaaaaaatagtatcagccaccactgtagccagatataatgaaaaatgtacaaaaacgattcacatttgtgctactgagaatttgttgttctgaaagagcaagtttaaaatgtacataccaaacaaaattccgatttactccagtcacacgaagttagttttaaattttgcactataatatatgtattcagtttaagttcgagaattagaaaacagctcttctagaaaatttaaaaatcaattttacccaatgacaggactaatgagtcttcctaaatgatttaatgaggtctttttaaacaaaatgtctgcatcatattaatgataagcaactagaagaaaaaaagatgtcaaacatgaggacataataatggaaaaatataaaaaagctaaaatttccgttaagtgtaccacatttctacttatgtatggagaatggctattcatctgacagagcaaaatgcagcctccttaccagtcactgttacaacatcatctttacgagcttcagccatttcctgaacatggacttctgagttcacatcaacctctttccctgataactgtaaatgagcttgaagtgaagatgggaccttgacaataatagaacctgtaataaatataatggagagcttagtaatataaagaaatcaaaagtaccagagtctattataaatttgactgacagggtagcattgctcctgagacactgtttttactcctcagcatacagtatttatttaaaccttttccttattcccaggtgcccaaagtttccttactctcggcattcacagtaacttctgtcaagaatatgggttattagcacattattaactactagatctgcttttgccaatagtcctacacagctcatccaacaccagaaagtgagtaatttactacacatgtagcttatagataggatttgccattgagcatttaatatgagccagacccctaattacattatgttttaatccccatattaactttatgaggtattattatcgccccgattttatagataagaacttgctcaagttcccactagtgctcgtgctggaacctagactcagctcaataattacaaagcccatgcttttttttttattattatactttaagttttagggtacatgtgcacaacgtgcaggttagttacatatgtatacatgtgccatgttggtgtgctgcacccattaacttgtcatttaacattaggtatatctcctaatgctatcactccccactgccctgaccccacaacaggccccggtgtgtgatgttccccttcctgtgtccatgtgttctcattgttcaattcccacctatgagtgagaacatgcggtgtttggttttttgtccttgcagtagtttgctgagaatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgccacgataaacatacgtgtgcatgtctttatagcagcatgatttataatcctttgggtatatacccagtaatgggatggctgggtcaaatggtatttctagttcaagatccctgaggaatcgctacactgacttccacaatgtttgaattagcttacagtccacccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatatcctttgtccactttttgatggggctgtttgtttttttcttgtaaatttgtttgagttcattgtagattctggatatgagccctttgtcagatgagtagattgcaaaaaatttctcccattcagtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggtcttcttctagggattttatggttttaggtctaacatttaagtctttaatccatcttgaattaatttttgtataaggtgtaaggaagggatccagtttcaggtttctacatatggctagccagttttcccagcaccatttattaaatagggaatcctttccccattgcttgtttttgtcaggtttgtcaaagatcagatggttgtagatatgcggcgttatttctgagggctctgttctgttccattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaaaaggtccttcacgtcccttgtaagttgaattcctaggtattttattctctttgaagcaattgtaaatgggagttcactcatgatttagctctctgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctctattcctaattgaataccctttatttccttctgctgcctgattgccctggccagaactttcaatactatgttgaagaggtgtggtgagagagggcatccctgtcttgtgccagttttcaaggggaatgcttccagtttttgcctgttcagtatgatattggctgtgggtttgtcgtagatagctcttattattttgagatacgtcccatcaatacctaatttattgagagtttttagcatgaagcgttgttgaattttgtcaaggccttttctgcatctattgagataatcatatggtttttgtcgttggttctgtttatatgctggattatgtttattgatttgcatatgttgaaccagccttgcatcccagggatgaagcccacttgatcatggtggataagcttcttgatgtgctgctggatttggtttgccagtattttattgaggatttttgcatcgatgttcatcaggaatattggtctaaaattctctttttttgtgtgtctctgccaggctttggtatcaggatgatgctggcctcataaaatgagttaggaaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtccagaaatttatccatttcttctagattttcgagtttatttccgtagaggtgtttatagtattctctgatggtagtttgtatttctgtgggatcggtgatgatatcccctttgtcattttttattgcgtctatttgattcttctctcttttcttcttaattaatcttgctagtggtctatcaattttgttgatcttttcaaaaaaccagctcctgcattcattgattttttgaaggtttttttgtgtctctatttccttcagttctgctctgatcttagttatttcttgccttctgctagcttttgaatgtgtttgctcttgcttctctagttcttttaattgtgatgttagggtgtcaattttagatctttcctgcttcctcttgtgggcatttagtgctataaatttccctctacacactgctttgacataccagagcataccagagattctggtatctttgacataccagagattctggtatattgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttcctgaggagtgctttacttccaactaagtggtcaattttggaataagtgcggtgtggtgctgagaagaatgtatattctgttgatttggggtggagagttctgtagatgtctcttaggtctgcttggtgcagagctgagttcaattcctggatatccttgttaactttctgtctcgttgatctgtctaatgctgacagtagggtgttaaagtctcccattattattgtgtgggagtctaagtctctttgtaggtctctaaggacttgctttatgaatctgggtgctcctgtattgggtgcatatatatttacgatagttatctcttcttgttgaattgatccctttaccatattatgtaatggccttctttgtctcttttgatctttgctggtttaaagtctgttttatcagagactaggattgcaacccctgcctttttttgttttctatttgcttggtagatcttcctccatcctttattttgagcctatgtgtgtctctgcacatgagatgggtttcctgaatacagcacactgatgggtcttgagtctttatccaatttgccagtctgtctcttttaattggagcatttagcccatttacatttaaggttaatattgttatgtgtgaatttgatcctgtcattatgatgttagctggttattttgctcattagttgatgcagtttcttcctagcctcgatggtcttcacaatttggcatgtttttgcagtggctggtaccggttgttcctttccatgtttagtgcttccttcaggagctgttttaggggcggcctgttggtgacaaaatctctcagcatttgcttgtctgtaaagtattttatttctccttctcttatgaagcttagtttggctggatatgaaattctgggttgaaaattcttttctttaagaatgttgaatattggcccccactcacttctggcttgtagagtttctgccaatagatcagctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagactggggaagttctcctggataatatcctgcagagtgttttccaacttggttccattctccccatcactttcgggtacaccaatcagatgtagatttggtcttttcacatagtcccatatttcttagaggttttgttcatttctttttattcttttttctctaaacttcttgcttcatttcattcatttcatcttccatcactgataccctttcttccagttgatcgaatcagctactgaggcttgtgcattcgtcacatagttctcatgccttggttttcagctccatcaggtcctttaaggacttctctgcattgattattctagttagccattcatctaattttttttcaaggtttttaacttctttgccatgggttcaaacttcctcctttagctcagagtagtttgattgtctgaagccttcttctctcaactcgtcaaagtcattctccatccagctttgttccgttactggtgaggagccgcgttcctctagaggaggagaggcgctctgattttgagagtttccagtttttctgctctgtttttttccccatctttgtggttttatctacctttggtctttgatgatggtgacgtacagatggggtttttgtgtggatgtcctttctgtttgttagtcttccttctaacagtcaggaccctcagctgcaggtctgttggagtttgctggaggtctactccagaccgtttgcctgggtatcagcagcggaggctgcagaacagcggatattggtgaacagcagatgttgctgcctgatcattagtctggaagttttgtctcagaggagtacctggctgtgtgaggtgtccatctgcctgtactgggggatacctcccagttaggctactcgggggtcagggacccacttgaggcagtctgtccattctcagatgtccagctgtgtgctgggagaaccattactctcttcaagcctgtcagacagggacatttaagtttgcagagctttctgctgccttttgtttggctgtgccctgcccccagatgtggagtctacagaggcaagcaggcctccttgagctgcggtgggctccacccagttcgagcttcatggccactttgtttacctactcaagcctcggcaatggttggcgcccctcccctagcctcgctgctgccttgcagtttgatctcagactgctgtgctagcaatgagcgaggctccgtgggcataggaccctcagagccaggcgtgggatataatctcctggtgtgccgtttgctaagaccattggaaatgagcagtattagggtgggagtgacccgattttccaagtgctgtctgtcaccccctttctttgactaggaaagggtactccctgaccccttgcgcttcccgggtgaggcgatgcctcgcccttcttcggctcacgctcggtgtgctgcgcccactgtcctgcacccactttctgacactccccagtgagatgaacccggtacctcagtgggaaatgcagaaatcacccgtcttctgcgtcgctcacactggcagctgtagactggagctgttcgtattcggccatcttggctccaccccaaagcccatgcttttaaccaccatggtatttcacacactcctacctcatcgtagtacaggacttgtgacctcattattataacacaactagaacactgagctcttgtgctttcagatgtgccttgtgtgtaacaaaaaataacaatagaaaaggattatttgaattccaactcactaatgtttcttttgagtagattacaggcttttggatacctaaggtaagacactcaacctgtatttccatacaacctggctgtaattcaagcttctaaaggagtaaatcaggaaaagtactctgttaggtatggaatcatttttcgaattatgtgggttgcagcgtaaattcaccaacacactcctatttcagaagtttttcttcctgtttttcattaaataaagtaggtaaaaggcccctgccataaagcattaaccccacctctgtggacaaagatagttaggatggggtttagaatgcatttacttatgggtcgtggttttccttccaatctggctaacatcagcttaagcttccttaagtaatttcttggtcttcctaactggagctagaagtttgagataaacatgatgaactgttctattctaaaaaaaattagggaacaatgcatattactagaactagtttattttattaagaaataaattgcagccaggcacagtggcttgtggctgtaatcccagcactttgggaggccaaggtaggtggattgcttgagctcaagggttcgagaccagcctggacaacatggtgaaaccctgtttctacctcccccagctcaaaaaaaaaaaaaaaaaaaaaaagctgggtgtggtggtgcacaactgtagtctcatctacctggaaggctgacctcccaagcttaggcgatcctgatgaggctgcactgagccatgaccttgctgctgcactccagcctgggtgacagagtgataccctgtctcaaaaacaaaaacaaaaaaccaaatttctttccagggttcaaatgtaaactacagacaggagattcccataacaacatatgagggctttaggaaaaaacaaaacaaaaacaaccctggaagatttcaggataaatagaggacacgtttttctaccaaacatactttcaaaagtagaaaatcatggatttaaaaaacttttttgtagggcttgatatgtctaaatgtatcaagtttcaagtgtgctaactttatgaacacttgtctctgttcttaaatgcataacatgatcttaaatttttcagatctttagaaatgttaagcaatgcaaagatttctaccccatctccctccacatctttaaaagccaaaaaccacctaccaaaactccattactgtttgtgaatgaagaattttcatgacttgaaaaccttcctaatgtcccatctttaacacttttttagaaaggagggctcttgttgtgttctttaacctcttttcacatcattaacttcttcatggttgacatcagtactatcctcttaaaaattcaaatgtgaactaacagcatcatttattgaaggcatattatgttaaaattagtgattttcccaaggacaaaatgttaagtggaaaagtcagtactcagattcaggtgtgactcccaggcccaagcatagcctggaacgaattaagaaggtcaccatattaattttcataaggtgaaagaaaacaagcattatatatttttccacatcagaaaatgttgaagacctaagagactccagtggctggctctgaaccctacagcaagacagtggcagagttggaatggattctggatgtctttgctaaccattaagaaagagttactgaataactttccattactcttaaaaagttactgttcccaagtgtattgagaattcggagatctgaagtaagacagaaatctttgttttcagttgtctttaagcttttgccagtaacatggtcccagtagaagaaaacataaaactgtaatcctaatcaaattttgcaacatcaaatactatttcaatagtttcaaatactattccaatattgttccagcaatattccaaataatactaagaaatattttaaatgaataaagactaacaatcttcaaaagttttacagttttctgtttgttttattttgcctactgtgcaaaacattaaattatttgtatgtaacagctgcttattcaaaactttgttcttactctgttactagttatattaacaatatatccttcttctctttggatctttgtgataatggagtacagttatatgacttacatgccatttataattttccctgaagcgtattacctgaagctcttagatttagtgaggacataagtttatcctattttaaagggagaaaatatgatattgagaagtcacaccggtgcatcagcaataactgaggtttcagacctctgtgttttgcagttttgacactgacaaattctagagatggattaaaaaaaactattacatcaatatggtaaagcaactactaatagcaggaacaatcagtctctgtgaggaaatattttccttgttaaacatctggccaacatgcaagagctgctagactatttaaaaaatttttttatacagagctacagttcttaactttctgcagccaagccacttcagcccctatggccaacctacttcacccaagccacttgtcaacacatatgtgtacatccatgtgtgcagaagaacagacaaattcatatttatctttcagatgaaaagtataccattttaaatgaaagagttggactcagaataagttgtgtcagaagttaaatgatagagacatatcataagtcttgatacttcaagagactaagtaatcactttagaggacctttctgtgtgatacctttatttaaggatcacactttgaaaactgttactctacactgattgcctgagaagttccttttacaggctggcagagaagcttccaaaagagtgtatggcagtgtttttccttcaaagattattctatttcagaatagaataaactgaaaaatccacagagtaacatttaaaaattccataataacagtcaaaatattacatttttgtttgtactacaaagggaaagatagtctgcatggccatctatcccaaaagttgtaaagatcactggtctagaaagctagcagaccagtgcctttaaattaggttctatcagaagatattttcttgaaatcactatgtcagtatagataatttgaccatctgtttcctgagtgttacataaaccttccttacatcatatgtcaaaataaaacattccagttcactaacctttatgggatttcaattccactttccccagttggctgacataaacatctatggcaccctgattagttgaggcttttagacatccagaagacgaatctaggaagaagaaaaaa

SEQ ID NO: 186 - DNA, 6588 bp, Homo sapiens
tcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgata

SEQ ID NO: 187 - DNA, 7815 bp, Homo sapiens
aaaagtcaatttctaatggctttctttggtcaccagatagtcacatagaataggcaaagcctacagaacagaaaaataagtaattgggtgccatgtaataatactacagggatttgaattaaggattgacatttcattttaaatgaaattgtgtaactggcttttaagtacattttaaaaggattgggtaggtacttgggtcgatacttctgtttgaggtgttcaagccacaaatatacaaatatatagctatcactgataaacctgggaagctgacccctttaggctaagttggccttcatgagatcagaatgcccagcacctgtgtatcagggtaacaccagctgactccttgatatagaggttctggaggatgtcttaccaggacagtcagggaagtcaggattttgtttgtttgtttggagatgaagtctcactctgtcacccaggctggagtgcagtggcacaatcttggctcactgcaacctccgcctcctggattcaagcgattctcctgcctcagcctcccaagtagctgggattacaggtatgcaccaccatgccctgctaatttttgtatttttggtagagacggtttcatcatgtttagccaggctggtcttgaactccagagtcaggatttgaccccgcctgtgctgcaaccttctgggacctcctgtaggaagtgctatacctgctttggaagaagcagctctcagaggaaataacaccaatgggttcctccccaagagatcccagaaaccagaggtggaacttaagctggcttgtattttttttatcaatgctctgactctgtatctcagtggaaaattctattcaacaagaagaggagggctgggcacagtggctcacacctgtaatcccagcactttgggaggccgaggtgggcagatcgcctgaggtcaggagttcgagaccagcctggccaacgtggtgaaaccccatctctactaaaaatacaaaaaattagccgggtgtagtgccacatgcctgtaattccagctacttgggaagctgaggcaggagaatcacttgaacccaggagaggcggaggtttcagtgagccgagattatgccattgcattccagcctgggctataagaggggaactctgtctcaaaaaaaaaaacaaaaaaaaaaaaacaaaaaaaaaaaaacaggaagaacataatttctcctctagaactaaaaaatatttgtattttatcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgata

SEQ ID NO: 188 - DNA, 8610 bp, Homo sapiens
aaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaa

SEQ ID NO: 189 - DNA, 18389 bp, Homo sapiens
cctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaaca

SEQ ID NO: 190 - DNA, 299866 bp, Homo sapiens
gttcagccacaaacaaatagacctctactctctgattgaatcttaaatgagccaatgaaaatgaagtccctactcccaatgtaacaacctagtaagaggtggaccaagaaagaatatgacctggttttaatggttaggagaactggtacaaacacttattagatctctgatcaggaaatactgcttctgagatcactgcttttcttaaaatgtgatatttaaggtatgaatgaactcctttgacttctcccttaagtacacaaataatgtgagcagggcaatatgggtagatcatgagctagagaccattgataaaagataaggccaaagcaggaatacctgagccctgaggagattgtacaagtttccagagagacagagagaaaaaatttcctttaaaagatcaagaatttgcatagactttttggcagtactgaaagctagaaggctgttctgaaaatgcacagtgaaaatgatttccaatctagaattctgtactatcaatcaaatgtaaacataaaaataaacattttcagacacacaagatgtggaaaaaaaactcacatgcatccttttctaggaaactactgtagcatatgctcccccaacacagagtaaaccaataaaagagaatacatgggatccaggaaatggaagatctagtacaagggaaaggtaaagagaattcctaggatgacggcaaaggagaatatgaggaagataactagagtgcaacttgaccaggctttgcaagtaagaggtgtctggaagagatgtctctgtgaagatggaattgttaggattcctgacatgttgggatatattgaataaagatttatataactgagattttttttagggatgaagaatagtaattacataaaaattaagccaataaaatattttttgtaggaaaggaaaagtatatatagtatactacatggatcagtcataaatatcatttacttaattataataaataaatatctgcccaaagatcaacctgtcatattctgatttcttagtacatcaaaatttttactactaatggtttgtaaatgttgagcatatttctgtcagctatttataatataatatgtgcataagtaattactcatcaattattattatttttaaagaaaggatctcactctgttgcccaagttgaagtgcggtggcacaattatagctcttgaaactcctgggctcaagggatctccccacctcagcttcctgagtggctagaactatgggcttgcactaccacacccagttaatttaagatttgtttttagagactggatctcactgtcttgtccaagttggtctagaactgctggcctccagtgattatctcaccttggcctcctcaaatgctggcattaccggcctgagccattatagctggccaattatttcttattttctaagcattattttagagagagcaagtcaatgaccaaacttttgaggatctatgttacatatttaagatggaaatcataaatatctatatataatgaataattgatggtaattaaaaatatgttttaagtggatactcataaatacaacaatgcatgtttttattatatactttgatgaaaatgatttttctttgaaaagagtcagtgcacttccattttgcctgtcaataagatattgtcattcactataacagagaggataaaaaattgcaaataattttcatgaagatactaattaaaagagaaaatgacataatgggatgctgtatcaaatactgcattaaaggatagcaatcataaatatttgtggtttgtggatggaggtaatggggatatactcctaaagtaatacaatgctgctactataatataacaaagttatttttccttttttttttttgaaatgtagtcttgctctgttgcccaagctggagtgctgtggtgcagtcagctcactgcaacctccgcctcctgggttcaagcaattctcctctcagccccccgagtagctgggactacaggtgcatgccaccatgcccagctaatttttttttgtatttttaggagagatggggtttcaccatgttggccaggctggtctcgaactcttgacctctgcctgccttggcctcccaaagtgctgggattacaggtgtgagccactgcgcccggccttttccttatgttttccaatcagatctcttttggttaccttattttcaaaatgtagtgaattaaagcaacattaaaaaaaaaggtgaacttagagggtcagaatggtataatccagttataaatctgagtggtttgaccattttcattataggcagaagactactggttaactttctaaaaacaaaaccatttctttcatttttgaaatataaaatgctatattaagccttttctcaagcaactattaagagagcacttactggcgaatgtacaaaaactctatttttgagtaattatatacctaatgccacttgaactaaagcatgtaagaaaaatgtgtgcatttttcttcatttaaggactcgtctatggtaaaaatgtatgactttttttcaaaacaaaagcagtgggaacatgggagaaacatgccttctttattgctgaaatatatattttcagtggttatactcttaaggaaatcctaaagctgtaatgcatttggtgtttttttttttcctgtaacacaataagaataaaatggcagctcagcatgagacaactattatacacaacatcagatatatttcaggtatttgaaagctggaatttttctctaccatgggttatggttttagctttataactgccttgctgtgaaattggacaagtcatttaacccttcttaattttcttccaccaaatcgcaaatggcaattattaaactccatactattttatctatgcatatactttgctattctatacagaaatatccctactaatggtacttcctgcaggtctgtctaaaatgctcagtgagtgacctgtaatccagctctccacttagtgaatgttactcttacctgtggagtcccttattaacaacatactgactctgcccttcaagctgcctgatatttacactcaaacacaactaccctgtctatgctttcctcttgtcagtgtggtctgtaggtgccacatataggacacttttagcaactatgtcaatcagatcaagtgattcttttgtggacttttaacctcaagcagaaataaaagttttctcacatttaccacatttaggacaatcctctttgatttaccactcggcaggtgagtggcaacacattatggtccttttgccttccattaatatttgtaagacttttttgtatttttttaagttccatatatagggggtacatgtgtaggtttgttacatgggtgtattgtgtgatgctgaagtttgatgtatggattctgtcacccaggtattaagcatagtacccaatagggagattttcaatgccttccccgcaacaagccaccctgcatagtctgcaatgtctattgttcccatgttatgtccatgagtgctcaatgtttagctcatacgtataagtgagaacatgagatatttgggtttctgtttctgaattaattcacttaggacaatagcctccagcttcatccattttgctgcaaagaatatgatatccttttttatggctgtgtaatattctatggtgtatatgtacaatcatgatggcctatatgtatattaagaattaaatagtaatatatatgcatagtaaaattatttatggtagaattataattttctagatgaataagtaactctaattcatgaaaaagttgtcatggcttgatttcctgcaaagtcataggtagatcctgagttgttactgaagctaatattattttacacttatatagcaggttgtaatatgctcaccattttgcaaaacattgggaatgaaatttgacctatcaagaaatcaaagtatgacagtttgatacgtgtgtttctttcttgagatctttcagaggttgcatgtatgtcaggtaattatcttttatatagcaaagtaaagattgctttataaaagcttttaagtttctggaaacatgaggaaattttcaagattttcataattttattcaagtaggaaatatcagacatggctctggaataggaacatacagacttgtgttagcaatatcctttttagaaaatgcagttggtgtatgtagcacccccagaaagaaagaaacgtgaagatgctctattctgttcctgaccactctgagtatcagactgctatctactgttttaaggatttagatttttgccagagccaaatatccagatatagctatagtaggctggattttctatcttggggatttaatagcagaataaaaatagtaattgggggccgggtgcgatggctcacgcctgtaatcccaggactttgggaggttgaggcgggcggatcacgaggtcaggagatctagaccatcctagctaacacagtgaaaccctgtctctactaaaaatacaaaaaattaaccgggtgtggtggcgggcgcctgtagtcccagctacttgggaggctgaggcagaagaatggcgtgaacctgggaggcggatcttgcagtgagccgagatcatgccactgcactccagcctgggcaacagagcgagactccatctcaaaaaaaaaaaaaaaagtaattgggaatgagcatgtatttaggaataaaactataaattttttagtattcattgatacatgtgtaaacatatataaaatctatgaatataatggaaagatttctgacatcaatacctagttatcttcttatctttcaaatatggtacttccagggcagtaaactcactttgtatttagctggcacatcttgcattattctgttctcttcattccacttatatgtatctcatgtcattttttgtactacattttgatacttggatagtcattatttgtattattagttgccccaaattttcaatctttacatcaacaagtactcaaagttgagtctaatactgtagcttaggtaagttctgtagtgattttgcttcttgctaatatgctctacaaaatgctggctccctggtttgtctattaatcccagcactgacttctgtctgtcaggctctgcaactttcatttgatcttgaatgtatgtccttgtgttggcttttgatacatagatgtgaccaggaagacccttttcttgggaagaatcccttttgagttggaattttagctcaggaatagatgcaaagggccatattgcttcctaaataataatattaaaaatgaccaatattttctgcttatcatactacttgctgtttatcaagtcttcatttctcacctgggtttaggcactggtaagaacagtaaaaattctggtccaaaaaatgtaataaacatttcttaaattccatttgggtactaaacactattctgggtcttccaacttttattatcttccagtcctcaaaacaaacctggctgatagatagtactgttatctgtaagattaataaactacttctcagatagacaatgtgaacttcccagggtcattcagctggtaaatggctgcattcaggtgtcttgactgccacttcaatgattcataatcgatatggtttggctgtgtccccacccaaatctcatcttgaattgtagctccggtaattctcaaatgtcgtgggagggacccagtgggaggtaattcagtcatgggggtgggtctttcccatgctgttcttgtggtggtgaataagtcttacgagatctgacggttttataaagggaagttcccttgtacatggtctcttgcccgctgccatgtaagatgtgactctgctcctcttttgccttccaccacgattgtgaggcctccccagcaatgtgaaaatgtgagtcagttaaacctctttcctttacaaattacccagtcttgggtatgcctttattagcagtgtcagaacagacaaatacaataattttgcaaaatttgagaccttttaaaatggcacagaatagggctcatctcagtgaatattctacgtgcacttaaaaagaatgtaaactttgcagggtaagttaggtgttgtaacctaaacataaaaattatgttaaagtggttgatagtgtttttcagactatgaatttaattttattataatatcagttgctgagagaggggtggtaaaattactatgattgtggaattatatatttctcccttgagttttgtctcttcttttgacttcatgtattttgaagctctgttattaggcacatacatatttatgatcattatgtcttcctgatgaattgacctgaccagtgttatgaaatgtgccactttactgctggtaatactgtagcttgtagtccattttttctgatatttgtataaccacacaagctttcttacccttcccatttgcttacttaccttcagcctagttgtatttttatactaaaatatgtctcttctagctaatatatacttgggttttgctctcttttttaacccatttttgataatatctgtcttaaagttggcatgtttagtttgttaacaattaattattgctgaaaggattgactttgggcttccgtaccagttttttatttggttctgtttgtcccatctgtttttgttcctttgtttttttcctgccatctcttggattactctagtaatttttgcatatgattttaatgtaactattgactttttagctatatctcttgcactcttttttttgtgctttttctacaaattaccataagcacctacttagaaacagcatttgtcacttaatgtaatgggcaataaacttgcaactatataaatctgattcttcttcctgtaatcctctgtgctaggctgtcatatttattacatttacatacattttacagcctcacaggatgatgctataatattttctttaaaatgtcctatggattttaatgaaattaaaaggaaatgtagctttttatatttggctccccactttttataaaaacatttttaaggctttttatttcttcctaaagatccaggtttttatatggtatatcttaagcctgtggaaccccctttatcatttatttttatttttgcccactcatatactctgtttcttatttttattgtttctgggccattggctttaagtgtatagtttttctgtaaacaacagacatctgcatttactttttaatctaatttgagactttaaaaaataatttcagcttttattttagattcaggtggtacatgtacaggtttgttacatgggtatagtatgtgattctgagatttgggatatgaatgatcccttcacccaagtagtgagcataatatccaataggtagatttccagcccttcccctcctctggtagtcttcagtgtctattgttctcatctttatgttcacgtgtacccaatggctagctaccacttataagtgagaacatgcaatatttgtttttttgtttgtttgtttgtttctccacctagcataataacctccagctgcatccatgttgctgcaaaggacatgattttattccttgttatggatgtatagtattgcttagtgttctatgtaccacatatttaaaatccaatggcctgttgatgggcacctaggttgcttccatgtctttgctattgcaaatgatgctgcaataaacatatgagtacctattgtcttttggtagaatgatttactttttatatacccagtaatgggattgctgggtcaattggtagttctgttttaagttctttgagaaatttctaaactgctttccacatcatttgttatagcagtgaatttctgttgacaatgaattctcttagttttacttttagaataaaatatttttacttttattcttaaagaatattttcaccgagtatagaatttttgattttttttttttagtttcagtacttcaaataatacttttccactactttttggacttagccatttctgatgaagagttattggccattcaagttgttgttcccttatcatttttctctgactgctttcatgattttatcactcagaaatctgactgtgatgtgtttaggaattgttcttttcatatttactctgcttggggttcactgagcttcttgaatatgcacacttattttttgcccaatatgggaaagttttagtcactatttgttcaaatatttttgtgctttaaaaaattacttcttctggaactgcaattatgtacatcagcacttttgcttttgtccaaaagttctctgagttactattcaccttttatctatctttttttgttctgtcttcatgttaggtaacttgtattgattcattttaaggctcatttatttttctgtcgtttccattctgtttttaagtaaattcaatttaagaaatctcagatattgtccctttcagttctaaaatttgcatttagagtttaaaaatcactttttaactcttctccaagatttttttaaacaatttctcattgtgatactattttcattgagaataattataataattcttttaaaatccttttgtgataattttactacttggtttttcttgtaatatgtctcagttgatgtattttctcttgatctgggctagacatttctgattcttcatgtgtcaagtaatttagaattgtgtctggggcattgtgaatgttatagagactgaatttggctgtatttctctgaagtatgttgatataattaattggttggagtcaaatggtaaactctgcctcttaactggcagctcagatctcggttcagttttttcatctttaacctatactgctctgagtttgcctagtgcatttgtagttttaggggtcaaatacatggacagggtttcggaggataatttggggctcaaatctgtgccttttcatttccctgattcctctcctatttatgaatatctataatttacctgaacttttctctgattttctaggatagaaagactgtggatttttctgttgtaattttagcaaattttatgtttccaacttcagtttgcccataggggaaaagccataaaaactgaaaatgcactccattctagtcccttttggccctgtagaatcttagccttactggaagccttattttgcattattgtctaaactgttgtgggctttaaaaaatattttaatatcataacttagagtttcacaatatcataatttcattttatattcaaatacaaactatttcatgataattaaatctttccaaagattcctttagacactttcccaaattgaatttttgtaaattatactcaaatactgatagagtgatttcacaagtaccaaaataaaatattttttcattgtgggcatttaaattaactaaatgtattatcaaactctattagaatgctaaacattatgaagcaagcttaaagtttataaagcagctttttcagtattcagaagctgcaatgggaattttgtttctgtgaagaccaaagatttgtgatctatgttggtggtgatcatagaagaaaaatcaagggaataaattgttgtgccaaaattacctgtataggcagtgtttttgatgtcatagagcaatcttggcttccctttcttattataatggtatcagattctcattgttaaagaattcctcatccccagctactctattactttggaatttgtagaaaggtcagtgagtctcaggagttgtgattactttttctagctgacatttattgatctcattaccttcatgctcatatttcagaaaaatttttttcattctgttaccatttcaaagatgacagaaatgctgcagtgctcactgtattagaactgtatgtaattaaaatttgtactgtgtttcatcacaattcactgtcagaaccatagcatgtgttgtttataaattagattgttataattagaacacacaatgtgcataaagaaggctgaatttatatgctaacatatcttttatatcttttcatgaaaatgaatgttgtagaatctttgggaataaaacattttactagtactgaatggctcacttgactctcgccgttgccagtgcttcgtcttaaacgattgcttttgcaaaatcatttctaaaaaagattctagagacaaggaatattaaagagatgtgtataaagatgattaagtaaactatacataaccatgttttaatttttcctaagactgagccataattagataggtttattataaatatatagatttataatatatgtaatactttcaaatatttaaactcacagttctagcccaattttacttgtctacatttaaaagaaaaactttaaaaggatggtgaaatagtttttaaaaaggtttatttgcatgaggtagatttaggaacagtttttcttttgtctgtttaagccacaattgtacatactgaattccttcttcctatttgccaagagaccatccaaccagaaagatttaaaaattctctctatgaaagtcaagaataggcacaggacattcagctgtcatgatgaatcagaaaactaatctatgaaccatttgctggaggttattttagatggattaatttacagaacaccctagtttacagaggctaataaattatagttgatagttatgatcaaaaccattattagataggtatgccattgtttatgtatacatcttagtcctttgggccgtagatttggcccctattaattcacttctgaggattattaatttctttattctcatttctaatttgagagataaaattcagagaagcatggtttgcccctcactggtggttcatcggttttaaggacctactgatactctgtaacctaaagtttgttcatatttctgacaaatttgcaatctctctctttacttgtatttatttaaagattactgacacatgacattcatcagtctcaggcaaacgctaacctcactgccaaacacaaagacataatcatttttgacttccgcattaggctcaaaaaaattctggattgaaatattcactaaccataacagaatatactaattccaagaaataagtgtattcatgtgccattttataaggtcagcctaatattcctgaagaaaacacccccatgttctttcttataaaatgacttcttattatttttaatgacaagcatgttttatgatatgtggataatacatgtgaagttcagagattctctgtgtaattaatgaattaatctaggtgggagataaactagttttaaaaagaaaatgagtctattttaataacactcatgtcttcagatattggtcagagaccagaactgtcttgtcaacccaagacattttttttcaataggcattattatggataaagcggattatttgaaatcaaatcaacaaatttactgactagtaccatatattaggtgccatgctggctgtagtagaaaatatgaagatgctggcaccaagtactgggctagtcagttatagatattattttatttattcccaacaatgttgaacggggcattagttccatttttatagctgatgatataggctgatggttaagaaatagtagagaaattattagataccagcaatgccaaaatgcaaagcccttttgtttattgtagcatcttcatatttctttgatcatacgtatactctgaatgaattatgaaaactatgctccctctcatgcatgtttaagttgaaacccaaatttttttcatcacaaataagttattataaataatgtgcttttgacatattgcaaatattggcatttaaaaatttatctccagatcactcacttaaaaatgtccaattgcatctaaatatcacaatgatttgatgctcttcatcatttattttttagaaagtacacacacatattgtttatgtcatagaagtgaatggctgttaaaatttgtgtcagctggggttctccagaaaaacagcaccaacgggatatacagagagatatataagagcagatttattaccggggttggctcgtatggttatagaagtcccacaatcttctgtttgcaagctgcagaaccaggaaagcagagaaagcagagggagtaatttggtctgaggagaatgtgattgaggttggtgatggtgttagagctggtctgagtccaaaactctgagaaccaggagcactgaagtccaagggcaagagaaaaatagatgtctcagatcaggcagagtgatcaaattcacactctttctgcctttttgtttgtatacaggcccttaataaactgaacgatgcctgctcacatgggctagtgtgatcttctttactcatcctactagttcaaatactgatcccctgtgggaacatcctcacagacacacccagaaataatgtttacccagagctatgtgggaattccttaccccagtcaagttgacccatgaagttaaccatcacatagttacatggtcaatagaaataacctttggttataaccctttggtcaatagaaacaatccttgcctctgcaatttttctgtccactcagttaatattaatacttctaccatttatgctggtttttatttggcaaacttttatatattcttatatttttaacattcgtgcagaattttgttttacatatatctcttctaggcagaatatatttttaaattttttaaatttttaatttttgttggtatatagtagagatatatatttatgagtgtatatatttatagaatacatgagatatttgatacaggcattcaatgtgcaataatcatatcagggtaaatggggtatccatcacctcaggcatttaacctttctttatgttacaaacaatccaattatactcttttagttatttgaaaatgtatgataaattattgttgactgtagccaccctgttatgttatcaaataccaaatcttattcattctatctagctatatttttgtgcccattaaccatccccatttccctctccaccattacccttcacagccttaggtaactgcattctgttctctgttaccatgaattcaattgttttaatttttagcttccacaaataagtgataacattctatgtttgtctttctgtgcctggcttattacacttaatataatgacctccaattccatccatgtttttgcaaatgatagaatctcattcttttttatggcttcattgtaaatatgtaccacattttctttattcattcatctgttgatggacgcttaggttactttgaaatcttcactattatgaataatattgcagtaaacatgagagtgaagatgtctcttcgatatactgatttcctttctttggggatatacctagcagtgagttgtctggattatatggtagctctattttaatttttttgaggatcctccaaactgttctccatagtggttgtactaatttacattacaacgtttgaaccaacagtgtacaagggttcacttttctccacatgctctccagcattttgtattgcttgctttttggatataaggcattttaattggggtgagatggtatcttattgtagttttaatttgcatttttctagtgatcagtgatgcagagcacattttcttatggctgtttggcatttttatatcatttttaaagaaatatctattcaaatattgtgtccctttttaatcaggtttgtagatccttttcctgtaaggttgtttgtactcatatattctggttattaatctgttgtcagatggatagtttgcaaagattttctcccactctgtgggttgtcacatcactttgctgactgtttcctttgcagtgcagaagctttttaaattgatgtgatcctatttgtcaatttttgctttggttgcctgtacccatggggtattactcaacaagtctttgcccagtcccatataatggagagattccttaacgttttcttttagtagtttcatagcttgaggtcttatatttaggtctttaatgcactttcatttgatttttgtatatgttgagagacaggggtctagtttcattcttctgcatatggatatccagttttcccagcaccatttattgaagaaactgtcatttccgcagtgtatgttcttggcacctttgtcaaaaatgagttaactgtagatgatggatttgtttctgagttctcttttctgttctcttttctggaacagaaaactacttctagatgaatattggcggaaaaatcctcgacaaagtatttgcaaaccaaattcaaaaataaaataaaagatcagtggaagagaaaaggaaacccaaaaacaaatccatacatctacagtgaacattaaccattctgttggataataccatgctgttttcatgttaataccatgctgtttttgttactatagctatatagaataatttgaggtcaggtaatgtgattcctccagttttgcttgttttttttttttttgctttgcttttgttcaagatagctttgactattctgggtcttttgtggttccacgtaaattttaggattgttttttgtattttgtgaagaatgtaattggtattttaatagggattgcattgaatttgtagattgctttggatagtatgggcattttaacaatattgattattttaatccgtgaacatggtgtcctgttcaatttcctttttcaaagttttgtagttttcattgtagagatttttcacttctttagttaattcccagttattttattttatttgtagctactgtaaacgggattactttcttgatttctttttcagattgtttgttgttggctacagacatgctactgatttgtgtatgttgattgtgtatcctgcaactttactgaattagtttattctcatagatttttggtggagactttaggtttttccaaatataagactatatcatctgcaaacaaggataattttatgtcttccttttcattttggataccctttatttctttctcttgtctgattgctttagctaggacttcgagaaatatgttgaataccagtggtgaaagtgggcatgcttgtcatgttccagatcttagaggagaggctttcagtttttccctatttagtatgatactagccgtgggtctgttgtatatggattttattgtgttagggtatgtttcttctatagccaattttttaagagtttttattctgaagcgatgttggattttatcaaatgatttttcagcatcaattgaaatgatcatatggtttttgtccttctttctgttgatatgatgtatcacattgattgatttacatatgttgaaccatctttgcatcctagtataaatcccacttggttatggtgaatgatttttttttttttttgagacagagtcttgctctgtcacccaggctggagtgcagtggcacgatcttggctcactacaagctccgcctcccaggttcacaccatcctcctgcttcagcctcctgagtagcggggaatacaggagcatgccgccacgcccagctaattttttgtatttttagtagagacgggttttcaccgtgttagctaggatggtctccatctcctgacttggtgatccacctgcctaggcctcccaaagtgctgggattacaggcgtgagccactgcgcctggccgcatgatctttttaatgtatgtttgaatttggtttgcaaatattttgttgaggatttttgtgccaatattcatctagaagtagttgttttgttcaatgttcttcctttggttttgatatcagggtaatactggactcattaagtgagttttgaagtattccctcctcctttcttttatgaatgcttggtaaaatttgtcagtgaagccatcaggtcctgggcttttctttcctgtgagactttttattgtgggtttgatcttgttattggtccattcagtttttggatttcttcgtggttcaatctttgtacgttgtttatgtctaggaaattatccatttcttctaggttttccaatttattgcaatatagttgctcatggaagtctctagtgatgctttgaatttctgcagtatcagttgtattataatgtctcctttttcatctctgattttatttattataatcttctctctttttttttagtctgcctaaaagtttgtcaattttgtttattttttcaaaaaaactttgtttcatcagtcttttgaattgttttcttcatttcaaattcatttatttctactctgatttttattatttcttctactaatttttgctttggattgcttttgtttttctagttctttaaggtgcatggttaggttattaatttgaagttatttttcttttctcatgtagatatttgtagctataaacttccctcttactactgcttttactgtatctcataggttttagtatgttgtgtttccaatgtcattggttttaagaaaatttacaatttttttcttaatttcttcattgacccacaggtcattcaggagcatattgtttaacttccatttgtttttataatttccaaaatccttttgttattgttttcaggttttattccattgcagtcagcgaagatattggatgtaatttcattttttttttgaattttttaagacttactttgtggcctgacgtatggtctgtccttgagaatgatccatgtactgaggaaagcatgtgtgctctgcacacattgatgaaatgttctgtaaatatctattaggtccatttggcctatagtgcagactgagtctgatgtttccttgttgattctctgtctggatgatctgtctcatgctgaaaatcaagtgttgaagtttccagctattattgtattgggatctatgtccctctttagctctaacaatatttgctttatatatctgggtgctctagtgttgggtgcatatatatatttacaattgctatatcctcttgctgaattgattcctttatcattatataatgactttctttgtctcttcttaatagtgtttttaatctattttgtctgatataagtatagctactgctgctcttttttttttttttttttttggtttcccttggcatggaatatctttttccagtccattattttcagtctccgtgtgtctttataggtgaagtgtatttctttcgggtaatgaattgttgggtcttgtgtttgtgtccattcattcattctatgacttttgatcggagagtttagtccatttacattcaatattgttattgatatgtaaggacttactcttgccattttgttatttgttttttggttgctttgtggtctgcttttccttctttcattccttcctgtctttctttcagtaaaggtgatcttctctggttgtatgttttaattttttcctttttacttttttttttgcgtctgttgtttgattttttatttgaagttaccatggggtttgcaaataatataagccattattttatactgatgacaatgaattattgcatgaacaaataaacaaactaaaaaacaagcaaagatacaactaataaaaactctacactttaacttggtcccgctgcttttttaaaaaactctttattgtttgtatttatattttactgtattgactatgtgttgaagaattgctgtagttatttttttgataggttcatatttcggtatttttactcaagatataagtagtttgcacactacaattactgtgttataatattctgtgttttactgtgtacttactattaccggtgagttttatgtgttcaggtggttccttattgttcattaacatccttttctttcagattgaagaactcccttttgcatttcttgtaggacaggtctggtgttgataatggccctcagcttttgtttggaaaagaccttatttttcttttacatttcaaggatatttttcctggatgtgctattctaggataacaatttttattcttcagtactttaaatatgtcatgcctctctcccttctggcctgtaaggtttctactgaaaagtctgctgccagccatattagagctccattgtatgttgtttcttttttcttgctgcttttagaatcctttctttatccttgggagtttgattgttaaatgtcttgacgtagtcttctttagtttaaatctgcttgttgttctataatcttcttgtacttgaatgttatatctttctctgggtttgggaagtgttttttgttgtccctttgaataaaatttctctctctctctctctctctctctctctctctgtctgctctttaagactaataactagctgggcgcggtggctcacgcctgtaatcccagcactttgggaggccgaggggggcagatcacgaggtcaggagatcaagaccatcctggctaacacagtgaaacaccatctctactaaaaatacaaaaaaaaattagccgggcgtggtggcatgcgtctgtattcccagctattcgggaggttgaggcaggaggatggcgtgaacccgggaggcggagcttgcagtgagccgagatcgcgccactgcactccagcctgggcgacagagagactccatctcaaaaaaaaaaaagaacaaaaacaaaaacgaataactcttgtatttacgcttcattctttttatccttttttcttttgtgtcttctggctgtatattttcaaataacctgtcttcaagctcactgattctttattctgctttattaattctgctgttaagagattctggtgcattcctcaatatgtaaattgcacttttcaacttcagaatttctgtttgattcttctaaattatttcaatcttgtcgttcaatttatctaataccaatctgaattccttctctgtgttatcttgaatttctctgagtttccttaaaacagctattttgaattctctgtctgaaaagtcacaaatctctgtttctccaggaggttactggtgccttatttagttcatttggtaaggccatatttttcttttgggtattcattagtgtctgggcattgaagagttaagcatatattgtagtctttgcagtctgggcttgtttgtaactattcttcgtgtcaagactttacgggtatttcaagaaacctgggtgttgtgacctaagttttttgtcattgcagccatatttgcatgagggagcaccctaagcccagtaacgctgtggttcttatagactcatagaggtaccaccttggttgtcttggataagatgtggaagaattctctggattaccagcagagagtattgctttcttttcttactttctcccaaacaaatggagtctctctctgtgctgagctgccggagctgtgggaggggtgacacaagcacacctgtggccaccaccactgggagtgtgctggatcagatctgaagccaacacaggactgggtcttatccaaggcctgcggtaatcactgcctggtgaccacttatgttcactcaaggtactgggtctctacaatcaacaggtggcaaagcccagccagccttgtgtccttcctttcagggcagagagttcccccagccctggacaggtctagcggtgccatcttggagctagtgcctggggttggaaaccttagggatctatctgatgctgtaatctactgtggctcagctggcgtaaaaacctcaagataaagttcttatgactcttccctcccatttccacaagcagaggcgtctctccccatggccaccatcacccaaggcctgtggcaagaactgcccagctgtcactgatgttcactcttcagtcagcttttagtgaatgattctcttcctgggactctcccttcagggaagtgggctcccctctgacccagggaaggtccaaaaataccatgcaagagccaagacctggaaatggggaccccaagaacgtgtctgatgccttacaccactgtggctgcactgggtacctaagctgcaaggcaaagtcccctttactcttccctctgtttttctcaagcagaaggagtctctccacatatccaccacagctgggattgtgctgggtcatatctgaagctagcacacatctaagtctcatccaaggcccacagtgagtattgcccgactaccactgctgattatttaaagtcgaagggctcttcagtcatcagatgattaatcctgccaggactggatccttcccttcaaggcagagggttcccttctgacccagggtatgtctagaaatgttttccaggagcaagggcctggaatgggagcctcagaactctgcctggcaccctcttctactgtggctgagctggtgtccaagttgcaagacaaagtccactttactgtcccccccctttcctcaagcagagggaaggagtctctctcagagctgtgagctacttccctggggttaggggaagggtgatgcaagcacttctttggccaccccagttggtgtttcacagggtcatgtacccccaagtccactggctccaagtccagcacagtaccaggacttttccaggaattgcagtctttgtggcctagactacctctccagtttatatgggactcaagagcattttccctgtggtggcaaggcttgctagaagtgaggttcctattgttgagatgggtgattcccctctggctaggctgttctaaatgctccctctgtggacaacagctgagttctgtctggtgttgctttccaccctgacagggcagcactaacttccaagacaaagtcccataatcactacagtcttcctcccctaagtgcacagattctgattctctgtctacaccacatggctgctgccagggggtggggaaggggtagcatcggcaattcaagacggtctttgctatcttcttcagtgcttctttcagtgatacgaagctaaaaccaggtactgtgattaatcacctgatttttgattctcataaaggtgcttttttctgtaggtagttgttcaatttggtgtttctgtggggagaatgattggtggaatcttcaatcgagacatcttgctccacctcctcctcctattcctttaatctttaaaccaaatcagacaaatcaatttttaaataaatttaaatgaatcatatacattgatataacagattcctgttgtactagttttcaatcactgagtaacaaattactgcacacataatggcttaaaacaataccaatttatgatctcactattatgtagttataaggtcaggaatggagtgactgaattctctgttcactgttgagctggttatgttttcatttgaagatcagggtactcctccaaactcattcacattgttggcagagttcagttccttaatgggtatctgctaaggtgtcactttcgtctctttaagggtcctctaggtcccttgccacatgaccctctttctcttcaaagacagcaatggggaacttcctgcatatcaaatacccattctcaaatttgaaactcttctttacgaacagagctcaactacctaggttaagcccactgaggataatctgcccttattaaggtcagctgtgccaggtatcataacccagtcatggaagagactattccatcacattcacaaagcctgtccaccatcaatggaggggtttatacagaggtgcacactgaaaggcgggtataatgggaacatcttagaattatgcctagcacagttgtctttacttttgtaatcttactttacaatgtatttggccctcttaatttttttctaaagaaattttactttattaaaaacctttatactataaagatagtttgaacagtggtcaagagtacgatgatcaagggcataattttagagccattatttagacttaaatcatagctcttactacttatgtgaaatggggcaagttatttaaccactcttgcctcagtgtctcatctgtaaatgagaatagtattacctgctccatagggctgttttgatgactaagtgaattaatatgcacaagacacacacaatacagtccaaaagaataacagttattaagtgttagctgttagtatttatctttcacagttacctggaagatattaattctgttttgtaatctactagatttcagttatacactgaagctatgtttatctagctacccatacatgcatttgctattatggatgtcctagtctttattaatattctattgcattaatattaacatttttattaatagaattaatatcaatgttggtattctattttatatcatggctctatgacagaaaaattgaagaaagtggaggtgcctgcaaagttgtctatacagaaaggagaggcaaagggaatacaaactcctgagatgagagatggctagatgtgtcctgagcaatagcaaatttgtccagtttgtggctggaagtgaacaaggagggagtggtaagagataagatcagagagagatcttatttgtctagatcatgtagggtcttgtactttagttttcactcagaggaagctagaaagccattgaaggttttaaagcaaacatgacgtaatctgtattttgttttaaaaagaaaacgatcattactgtatcacactacattgaaacaaaggtaagagaagcagcccagatagttgaagtggatcatgacagtagcttagactagagtagtagatatgggggtagttagaattagattatcttgaactattagattctggatatttgaagaaaaagttgagagtatttatagttagttgtatatagttatgaggaaaagcaagaattaagttatgcctataaatgttttgatctcagaaatcagaaaaaaaatagaattgccatttactgacatataggactatgagaggaaaagatatggaagagatcaagagtcagttttaaacatgttgcctcttagttgcctagctgaagatgttaagaaaacaatttgggaggctgaggcagaagaatggcgtgaacccgggaggcagagcttgcagtgagccgagatcccgccactgcactccagcctgggcgacagagcgagactccgtctcaaaaaaaaaaaaaaaaaaaaaaaaaaagaaaacaatttgaacatattcatttagagttcacaagtcaggtttggcttggtgatgcaagttagcaatttttcaggagattgacagtatttgtggttatgagtttacatgagatctcttagggagtgaacatagataaagaggacatgagtacaggaaaagagtcctaaggaatatcaatgttgcagataatgaaggaagagagaaagaaaggggacaaatgcgggagttatgcctctgagtagacaataagtggatggtatcggtgaatagtgcatgatatccagtaaactcaggaacatctgagtttagataggagaattaacagttcattatactgctggacaaaattcctacccactggggtaggttgttcccataacacttgggaatagagtggggaagagagagagagaaagagagagatgagattggaacagagggtgggagagagagattgggagaggagggaaagggaggagggagagagaatatgaacaagtagtaaattagggatggccccatgtgtttcaaatgtgaaattgtaatagaaaatattgttatattttgaatttttatgtgttatgatacaggatttggccaacagtaacccatggtcccattctggacagctgcttgtttttgtaaatagttttattaaaatgcagtggcactcattcttttatgcattgtctagggctgctttcatcctgcagcagaattcagtagttgcaataaagaccatatgcaaaggaacaaaactggacccttgctttcaccacatacaaacgttaacttaagagggattaaagatgtaaatgtaagacctcaaactacaagaatcctagaagaacacctagtgaacatcattctggacatcggccttgggaaataatttatgactaagtcctcaaaagcaattgtaataaaaattaaaactgaaaaatgaaacctaattaaactcaagagcttcagcacagcaaaataaactattaagagagtaaaaatataccctacagactgagagaaaatattcacaaactgtgcatccaacaaaggaccaatatccagagtctgtaaagaatttaagcaattgaacaagcaaaaaaaataataatcccattaaaaattgggcaatagacatgaacaaacactcctcaaaggaagactggcaagtggtcaataaacatataaaacatgcccaacaccactaatcatcagagaaatgtatttcaaaatcacagtgagataccatctcacaccagtcagaatgactttatcaaaaagtcaaaaaacaacaggtgttggccaggctaaggagaaaagggaatgcttatacactgttggtgggaatgtaaattagttccactactgtggaaagcagtttggagacttctcaaagaacttacaacagaattactctctgacccagcaatcccattactgggtatatatacaaaagaaaataaattattctactaaaatgacacgtgcactcatacattcatcacggcactttcacaatagtaaagacatggaatcaacctaggtgcccattgttggtggattgaatgaagaaaatctggtacatatacaccatgaattactaagtagccataaaaaaagaataaattacgtcctttgcagtaacatggatgtagctggaggtcattatcctaaggaaattaacacaggaacagaaaaccaaatactgtgccttttcacttataagcgggagctaaacattgagtacttatatacataaatatggcaacaatagacacttcgggcttctcgaattgggagggagggaggggttgagtactatgctcactacctgagtgatggatcatttttaccccaaccctcagcatcacacaatatacctacataacaagcctgcacatgtatccctgaatctaaaacaaaagttgagaatacaattatccattcatctgtttatgacatttgggttgtttctacatcttggctgttgtgaatattgatgcggcttcagatgtctctttaagatcctgatttcaattcttttggatggatattcagaagtgtgatgctagatcatatggtagtggtaattctactaatttttttgagaaaactccatatattgtgttttcttctattttcacactgaaatgtttgttgactactgtgatagaaaaccaaggctgtcagagtataaggtaatagaagattgttgtttggtagcatattctcagagaagagcaagtccccataattttgccaaatgtgctctggggttaggcctgtccaatcctgatgcgcttcacccattgaacaattcatttcattattcaatcatgtaaatggaacattaaaaaaactggtcactttttttccttttaaaattattgtcctcctctgattcatttattttacaattaactattgaacacttagcatgcaggaggaccgtttttctaaccacagaggaatagtaaactagacaaaaatcttcatccccagaggagcttatgttctacacctgtagtgctcatgtcttgaaattttacaactactaacttaaaacttttgctaggggactctgaagaaaatgacagcttgagtgtttatcaactcttctactcccaatcatttgtctgtctaaagagatagcatgtattctctgccactcttagaggtgattagcctttgtgtacttgtgatttccctgctggagaaaagtcatgctaacctgcttgtgcagagtcctgggaaggtcgactatgtcttgctagaccttgaggacttgcaggaaaattgaaagctgaaagactactgcctcataagcttggtaagtcctaggcagatcctcagtagttgattcctggtcagcagttttgttttataaaaattttgatatgtacaccagtaaaagacgtatatagaaacatgagacaagaatagtaacatcagagataaattagatggtttttctaaggcagcaagtacatatatgtaaaatatcacctcaaagagcacgtgtaaagaaagaaactagaaggcccaggcaggaggattgcttgaggccgcgagtttgagaccagcctgagaaacatagcaagacctccccttcacaaaaattttaaaagttagctgagtctgttggtgcacacccgtagtcccagatactcagaaagctgggttgggaggattgcttgagcccaggagtttgaggctgcagtgagctaagatcacgccactgtatgccagcgtgggagacaaaacaagactctgtccccaccgccccctccaaaaaaaagaaagaaaagaaaaagaaatcaactaacagattcaaggtgtcattgagaggaactatgtgtggagtagtcaggcatatttatgacttgagaaggtatattggaaaagtagttaaatttgaatgagatttagggagagcagtttaataaagaattgtgtttagctgaatagaaccttaaaatgagaacaatttaatagagttaaattaaatttcaagataaaagtttacatactttatgcaagtacctcaaacctggacaaagttgtaatgtcaggaattagccacaaacatttcttctttgattgaaatttaaggtactttcaacacacttgcttcactcttaatatttgattcaaattatgtttttcataattttatataatgccaaatcaactaaagcagattttactcttacaaatcatgtacacatatgtataataatgagactgcatggagtccagataaaaattacattttcttatgcactcacaaaataaggaggtttgatccctgttttggaaatgtccaccaaataatacaattttctctggggactttagaaataggccaatctaatgaaaaagaaaagacacattgaaatgcagaacatgttcttcttgaaaatattgatgtattaaatatttatgcaaacatattaaattggcaagtgtatgaaaacattattacatattcatcaccttcacatttcatctttttgagaacttctttcctataaaactaaaatggaagactaaaagttttccaaagccacatttttcgaattaataacattagatagtttttcttcagtttatattaattcacataaataacaaaattaatgttggaactggaaaaggctaataatttattcaaaatagaagcactaaagtgctgtttcatcattagcctttcttcctaaaacctgaattggagcttccttttatgaaagatgctcccttagagtgaatattcactttgaaaaataaatgagctcttttaggtcatggagttatttaccaaacaactggctttgtaactactccaaatgtcataagagaattaatgcatttccaaatttctaacttctcccagagtgtaataaatctttgttgactctaaaattttatgatctttggaaagtgtcatttaaattaaaatttaaattgattatactatcctctaattaaagtcagaaagttgaaatgattttatatatgctctaaaagcactcatgtttaatataatctgatttgttatggtgatattgtgttctgcattcaaagctttttctacttccctttcctgctaaattctttccccatttctttcatcttcttcttacctcattatttatttgattgaaacatactcatcactattttattcttttatcttcctatcttttcacccctctgaccatttttcaccggcttgtcttcctttctcgcttgcaccactctccttttgttcacccttgttgatattttttaattttataatactttagttttaatttttgtggttacatagtacgtgtacatatttatgaggtacatgagatgttttgatacaggcatgcaatgagtaataatcacatcagggtaaatggggtattcatctcctaaagcatttatcctttgtgttacaaacaatataattatactcttttatttattttaaaatgcacaattaaattattattgactgtagtcatcctgttatgctatcaaatactaggccttattcattcattctatttttttgtacccattaaccatccccacttccccctcagctctccactaccctttcctgcctctgataactatccttcagtcatttacaacaacatggatgaaactggaggtcattatgttaagtgaaattagccaggcacaaaaagacaaacctctttgatgttttaaagattgttgtgttaattgttttttctcactttgagtcctcatgatctctgttttaatagtttgttcacattaacaaccctggggtggggtagcaagttcttggtgtttactctacttaatttaacttggctattcctatcttacagcctggtaagaaaaatccacatcgtgacacggaagagatggaggaagaagagaaaacaaaaggtcagagatgtagccctacatagctgattttaaaaggaacttaaaattttactttggctaaaattgacctctcctgtaatttaatccaaacctctattgcttgtgtgtggccaagttcagtagtctttggagtctcacttctctaattatccaaatgcatttgttgaagccccatcccctgcctcctccaaatcccttaataggtttgattctgctcactgctcattgctattttcatggtgccgctgaattccgctctccttctctgtttctagccttttcaacattgctttctcctctcatccctggcatgaaacacagatgctggttattcaatctctaaagcactgttcttttaagaataaacttttactgaagaatgggggataaaagatggagcgtaagctcagaacagcacagggagaaaatgtacaagtaaaactaagttatttagtttagagcttcttggtcagaccctccttagtcctgcttgccaatttgtgctagattatttttttcctggtgactgtttcccgcacctctcctccccattcagggaccccaaagcatgttcttcagtgaccaggaaaatattttatattcttaatacttcattatggagaaaaatttatttcattttgtataaccactgtgtgttagtttcccatggcttccttaacaacttactacaaactgggtggcttaaagcaacagaaatttatttttctcagttttggaggccagaaatctgaaatcaaggtgtcaggaagaccatgctcttttcagaggctctagagaagattcatttttctgcctccctccagcttcttgtggctccaggcgttctttgattctccttggcttgtggctgcatcactgatttccgcttccgtgttcatgtggctcttcttccgcgtgtcttctcctttctcttacaaggacacttcgttgcattcagggcccactcaggtaattcaggatgatctcatgccaagacccctaatctaattacatctacaaagatcccttatccaagtaaggtcaccttcacgggttctgggaattaggatttaggcatatcttttggggagccatcattcaatgcacgacataatctaaacagactccagttttctcagctttaacagagacaatcaatcaaataagtttttgatttaatttaaaaataaaaacagtatttctgtctctcagaataattctgcagcccagttcttagagcaaattacagttagatttaaaagaatgcttttcttctcattttaaagatttctctttaaaaattgttaaaatgacctaacattttaaaagacggaaaagtaattgtaatatcaaaaacttaacacaactacatatttatacaaatgcctttataatctttgtgtatatgtgtgtatatatacatgtgaatgtataaatacatacttgtaatcatgatgtacttaacaactgcagattgtgtttaatcttagcatattaaataagttttttcaatgttttaacgtatgttttaatttaccactttttaattttttaatcttaatgatttaagaaagtattagtcattgtagaaaatacaaataaactaaaagaaaaatgaatcacctgaaattcttttaaaaaagaaagccaatctggagacacatacatctgttttgttttgttttgttttgttttttgagacggagtctcgctctgtggccagccgggagtgcagtggagcgatctcagctaactgcaggctccctctcctgggttcaagtgattctcttgcttcagcctcttgagtagctggtattacaggcatgcggccccacacccagataatttttgtatttttagtagagacggggtttcaccatgttggccaggatggtctcaatctcctgaccttgtgatccacctgcctcggcctcccaaagtactgggattacaggcgtgagccactgcacccagcctctgtattttttaatttaattatatcttcatgtttgtatgaatctatatctgtagctgtatctacatttatttagttttggctataaccccatttcaggaactagttgactaaaaaataaacttctattgtttttgaattattacatattttgtggtcttttaaaaagtactgcaacctcctctatgaatgaatacacttgtttttataagttttgaaacatattgttgaatgacatttctcaaagcctaagcacagatgataatccctactgcttcttaaccaagattataatgacaatcttagaatcaaatgttatcaattttaatatttattagagaatgtctgacaacactttctagagattctcttattttatcatgttgccaattttcctaaaaagtgttaagtgagattgttaaggctacaatggatgcaaataatgttaatactataatgaatgcaaaattattaatttaaccattcttccatcattaaaccttgtatatatttctaattttttattgttatgtttatacatattgatttctctgcagctaaattattcagttacataaatttcccagaaatgtgggtattcagggaaattgtggaaataaatctagtcttcatacagattgcagtttgccttttataagggttatatgaagacagtttcatcagagtataagagtaaaccggttttacctcaagttcattatcattgttgtattttgatattaacatcagtatttttaatataaaagtaatagaattccaccataagattagtttaattgcattgcttctgtctcagaattgaagtttatataagttcctaaatagctttaaactcatttaatgtaatttatttttgtctacttatttttgggaggcttaatttgaataaattgtgtttttattgcagatagatcgtccctctggtgatctttatctatttaaatttcctatgatttgtttttactcaatttattagtctataaagaatttagattgatataaggtcaatttccacagattgctaattaataatctttatttattagtagtccttctctgttactttatgttgcctatgtctaaaaaattttctatagttttgttcaggcattttcactatgttctatttatcatcacacttatttttgttctaacagcatgctgttttgattatcactgttttaaaatgtgacttgatatctggcagagtcggcagccccacctcacagttatgctattaaacatttaaaaaataatatctttttttttgcattttaaaaagttttgtgaattggcaagaaaataattaaggactattttaatgggtagtgtgccaaccccacagagcaacttatgtgagagtacctttaaaatatattagtcaatagtcaatatttgcattatagaagaatcagaaaatatccaaggagtattttcatactaaaacaggtgttttcaaatgggaactaagaaatatgtgattatttattggttaagataaaatgaaaattaatattactgtactatattaggggctttttttgtttttaaattcgaatatacaggtattttgtaggaattttggcttacttgaaatatcaccggatgtcaggctatcatccctgaaaattgtatgggttttatattctgccattcttttaacataggagtctagcaacctacaacaaaagataaaatatcttacaaagctcaggagttaaagggaaatgttctaatattgcaagaagtcaggaaatacagctttgttttggaggaatggaactacatttatatctggaagttaattagatattgtgacttataaccaatatgatctaattcataatgaaagaattttgcaaaaaaaaaaaaagatttaaattttcataggatattttttgtgttggcgatttgcctgtgtagttgatttgcatgaagcatgattaatgataattaaggaaatagttttaccaggtagaaggagatgaaaaattatcctcataaaataacacttcacagggtaagcatttcaacattaaaaaatgattcattgcgattttgtgacattaaacaactatgtgaactcgtaataagataaacttattagccagtgtttgttaatttgatttgtttaccccagtcttgagttttctaggacaaaggcttaacgttccacttctttctacaaactgcacaaggtcatgaggcaaattaccagatcaagacaatttgacaagacaaatgcaaacattataaatcagttcatctatgagtaattgaagatgtgaaactaaacatagtaaaaattcatgtttgttgttgttaaattgctagattacaatctcagtttctttactttcaaagggtgaatgcttttgagaaaatcaaatccattttacaactcacacataatgttttatgtggctgacagcataagtgtttttataagtctcccatatagtctaaaatataaaagccttgggtcatgtgatatgaatagttaatatatgagtttatatttagaatacaaaagatagtataataaatgctattaactcaaaataatattgctaaaattatagaacttatatattgaatgaatgtattataaagctcatttatttcaactttggttcttgacacatgtacagtggtttaatacagcctttattttggctgagtggctatggattttttataattataagaagagaactgtggcatattcagtatttttacttgtaataagggtgggctttatgggcatgccaccaatgtggttgcccaggaatccacgctctgaagggacccacactttaatgttctgctattactttcttgaaattcttaataatattttaattaaagaaacctccttttcatttcgcattgggctcctaaaattatatagctcatcctgtctgtaaccaaatactatttctgagaccctcttgtgttacagttccctttaagcaaaagactacagtcctctgatatttggggggttttcttcttgttttttttttttatgtatactttcttttccttaaagttcaaaaagagaactcatttaggggcatactggcatgtgtgaattgttttatttttctgatcacatgacttttggttttaggctacaactcttgcacttttcttcctcttagaaaatgtattaataagataatgttgtaaatgctgttgcaactgcaagctgcattacgtggcctcatattttcttccactgacaaaaaagtatgtataacatagtaagtacttttatctccttcacctggattcagtgattattaacatttacaccatttgctttgtctctctctcacacacatagacacatttttcttcggattcatttgaaagtaaattacaagtattttgacatttcactccaaaatatttcagcttgtatctcctaagaaaattctcctgcatgacctcagtgccatccaaaatatttaaaattgataaaatatacctaatattatttcaattcaaatttctccaattgtccccaaatattttttattgatttaaaaaacctctaggatccaacccagaattatgcattacctttgattcacatgtctctagtttaataaaaaatatctatacttgtgatttttcctgaagaggatgttaagcttgatgaaggtaggtatattttctttttctccaatgtggtgtgtggaattgagggaaagacaaaaaagaaaattttctgtctgctcgtcttgagaagctataagccttgtattatcttcaaggtaataagaacagattgtataatagccccagtgtactgaaatttattttaaatgtgagaagtatattcaattaggttgtgttttaaactaagtgtggcatctggaaatcagaaattataaatttggaatatacactttgtctttaaatgaatggttccttcccttgaatatgacatgggaagggtccaggaaaagtagaagagggtccaagccgcagtgaatgataccgccatccttccagacttcactgggtttctctgagccagcagacacggtggtgatcacattgcttggcatttgctgggagctgagccctcttctctctccatggttttgtcaagctggcaccataactttgcaaacggtgaaatgagaacacataagtgctgtgtaaacagcagggactcctgtttttctttctttatcattctgtcatctgaagtctttctctacctcctgtgcttatggaattcttctttgaggagagggaggcgtgtggaatgggattgggtgctctactattggagatttatagataggtcttatttgcttggttgtgaatccatgaattattttggaaaggcagtgtctttctcttgatgactcagagaaacatcagtcaggatcaatggcttcttgatgatgtaggcttaatgaatccaaatcattgaactgaaacttttcttttaaaatttcaaggcatataaactcatgaaatcagttttgtttcttatcatttgccatgtgttctcagctatcactgtacaactttactgtctgacttaactgatatgcttttgcaaaataagtaattgaaactaagtctgagaaaacctcatcctaaattcttttcttgactttgattaaatcatcatccctgtctttgttacttgatttgctagggggcagtactaaaaatattgcatagggacctcaggactctacaggtccctcttttgcttagggacctcagtactgtacaggcactctcactccactttttaatcctgttgggttcatttcaggagtacacatcactatcttaaggattttcaaattgctgctaaaaatgccttctctttttcttggtccctccctctctcccttctttctttctctccttccttcctttcttagttctatttggaacctaaactgagttagacattaggcaattgcaaaacattgttttttcttatttcaaagttttaaacctctgttcagttaaatattagggtaaaacagaacagatctatcaaaaatgaaaaatggtcgctatgaagaaagagtgcaatcagtaagctaataaggcagcctagagtgaaagaatttagaactgttagggaaaaacaaaaactagattaaaatatgtagtttctgaagactttctcaaaaaagtattttgttcaattaagttattttaaaattttcatagcttttcatattgtagtctcttttatagatacatctgacaaaacttttaaaacactgaactattttggtttccagtgctgtgtagtccaggtcaagaatggcagtggctgggtcctgaatttctggcttgctggcttggtcccagctacagctgaggagatctatgtccagtagtaccccggggaagagggctcagcttacatgtggaagggcctcacctatctgttgcactttcctaggggaaagtgagcatgcttaatactttcctgaagcagccctgtgaagaactctgagatccaggaacattacctaccctatctctgcatcagatctaggctctttccctggtgagactgtaaccaaattctattccataacccttatatgaatctgcttctgattggctgtaaaggggatagcattgatttggaccacgactttctatatgggctagaaaagtatatgggaccttgtgcccattttctttacttgtatcaagtggtgaccagtatacagatggtcccccacttaggatggtttgacttaaaatctttttactttcaaatgtataatattatgaaagtgataccattaagtagaaactgtgctttgaacattcatacacttattctggtctttgttttcagaacagtattcaataaattacatgatacagccaatactttattattaaataggcatcatattagatgattttgctctactctaggctaatgcaagtgttccgagcacatgtaaggtaggccagactaggctatgtctggtaagtcaggtgtgttacatgcatttttgacttacaatattttcaatttaggatgagtttctcaggccataaccccattgtaagttaagtagtatctgtactgatcttccatctctttgcttgtggcaagagatggcataaataaatacataaacttagattggtcatgaggaaataaaacaaaacaaacaccagagaatcaggtagtgggacatgaactctattctcagcttgaatgactctaagcatattgttccttctttgtgccttgtttcttttgttcaacttcatgtccatgaaattcattcattttcttttgtgtagcagttacttgcttttattgttatctaatattttactatatgaatagaccacagtttctatccatgctatggttgagggacatttggattgtttccattttgaggtttctatgaatacttcttcaataaacattcttatatgtgtattttggtgatcacctgcatgcacacatggcatggaattgctgggtcatagggtatatgagtattcagctctaggagatgttgtcaacagttttctggaatacttgcactaatctcagtacatgctatatgaaagtttaaattatttttcatccttgccaacacttagtactgttagtctctttaattgtagccattctgttggatgggtcttgctatctcattgactcttcagtgtacctctcaaagagtttttatacagacacacacacacacccccaagataaacatacagagcattgacagcattcaagaacactctcttatatcttcctagtcagtatagccctatctcttcctagtcaatataccccacccaagaaataacagctatcccaacttccatcaacataaattatttttgtctgttcttgaattgtatgtaaatgaaatgacagtttgtagccatttgtgtctcaattcttttgcttatttttatgtctaggatattaatatgtgttaagatatgaacattgcaagcaagttttattttatattgctgtgtaatattcccttgattgatatattacattttatttttcccctcttttgatcatggacacttgcattgttccaaattttggctattgggaataaagcagctataaatattcctatgtgtgcctttagtgggtataaacactcatttatgtttactgtttttctaggaaaaggattgctggtcatggaatagataatataagtttagctttactagatattgccaagcagtttctcaaatgagtttttccaacttaagtattttttctataacagcaattaatttattgagaaaagaggaccaggaagatttcagtttatttttaacatttcattcttaattttattttatttaaatttacaaaattgtatatacttgttgtatacaacataatattttgaaatagaaatacattatggaatgctaaaaggagctaattaatatatgcattacctcagttatcatttttgtggtaagaatatttaaaacccattctcagcatttgtcaatactaaaatttgaaattagatccttatgtcatattatataaaaaaaaatcagattagtaaatgtaagacccaaaactataatataaaactaccagaagaaaacgtaagggaaaagctctgtggcactgatatggggaatgatttttgtggctataacccccaaagcacaggcaacaagtaaatgggcaaatgggattacattaaactaaaatgcttctgaacagcaaaggaaataattaaaaagtaaagagacaacctatggaatgagagaaatatttgcaaaccgtatgtctgataaaaacttaatatccaaaatatataaggaattcaacttaataggaaaaaaacccgaataacttgattaaaaattggcaaagtatttgaatagacatttctcaaaagaagacatacaaataatcaacaggtagatttataaaaggctttaccttactaatcatcagggaaatgcaaattaaaaccaccatgagatatcacctacacctattagaatgactattaacaaaaaaggcataagataacaagtgttggggaggatgtgaagaaaaggtacactgttggcgagaatggaaattagtacagccactatagaaaacagcatggagattcctcaaagaattaaaaatagagctaccatatgatgcagcaatcccagtcctgggtatatacatccaaaggcaataaaatcagtatgttaaagaggtaactgcactcacatgtttattgcattattcacagtaaccaagaaattgaatcaacttaagtgtctgtcagtggatgaatggataaagaaaatgtgttacacatacacagtggaatattattcagccataataaagaaggaaattctgtcatttgtgacaacatggataaatctggaagacattatgttaagggaaataagctaggcacaggacaaataccacgtgatgtcactaacatgtggaatctaaaaatgttgatctcataaaagtagagagtagaaaagtggtgaccagaggctggagtggtagtggttgtgggcagttggtgagatgttggtcaaaggatacagagttttagataggaggactaacttcaagagatctatcatacagcatgtttttccaatttaaactcccaccagcaatgtgagataattccagatcctggtcatcattttgtagtttggtctttttagttttaatcattctgaagggtgggttgagatttgtcattgctttttaaatttgcatttctctgatgaaaaaatatattgagcatcttttcttatgcttcatattaagagtttcaatatcctcttttgtgaagtgcctttgaaattcttcttttcttttttaatgtttttctttgttattggtttgtaggagttctttatattcaagatataagttctttatattcaaggcataaattctttattgtatctctatattgtctgcatgttttcccagtgcagtttgctttttcatttgtgatcaaaagaaaaaccacagtataaaaaaaaaagatgctctgttagttaccagtatttaaatattaggaggatttatagaaaaatctggatttttaatttcttttaaagtagtaggaggatcctgcaacattttgcttgagatctcatataccttaggctgcatggtagctactcccatgagatgcctactatggtccctgttgcttcctacaccaacctacttcacaggttcataataccagcccagttctgttggtgcctagtgtgagagcctgatctaaggtctcccttttttaaatttatgagctgtacctaccagagttttttgcctgacaggttcaatagtttaagggacaacgaaggtcccttttggatgatacatacttaagaatgccaaatctctgactaccaagtaataaaaactttaatgtaattgaatgcatagtttttacaataattcattttttaagtggcaggatataaagcatcatatctgggaggagaagttgagactttaaatagagaaagtgagaatttaataatagtggaattagcttaaatagagtttaaatagtagaatcagtggaatttgattagatgtttcataggatgcagatgtaaaaaggcaaaaatatcataacctaaatttcagaatttgtcctatatatgtgtgttcatatatatacatatatgtatatatacacacatatatatccccatattgctttgggtgttggaaccatagaagtggacataatagagaaattctctgctttcatggacttgtaattcaaaaataataagtcaatacataaatgtacaagcaaatattaaaatatacagtagtttaagctgctaaacaagtttttatagtaatcaagacagtatgatatttgtgaaagaatagacaaatagatcaattgaattgaatacagcccagaaatagctcacacaaatgcagtcaattgatcttggacaaaagaggaaaggcagtttaatggagaaagtatagtcttttcaacaaatggtactggatcaacgtgaaaaaaattgaaaaagaatctagacacagactttccacatttataaaatttaactcaaaaaggataatagactttgccctttacttttaagggcaaaaccataagaccctagaagaaaatacagagaaaaatctagttggccttgggtctggtaatgactttttaaatagagcactgaaaacatgattcaggaaagagaaaattggtaagttgaactcaaattaaaaatatctgctctgcaaaagacacagttgaaagaatgaaaagatcaaccatggacgtggagaaaataattgcaaaacatatctgataaaggattggtatctaaaatataagaactcttaaaagttagcaacagtgaaacaaacaacttaattaaaaatgggcaaatgacatgaacagataattcagcaaaaaagatatatagatggcaaataagcatattgagatgttcaacatcataagtcattaggaaattgtgaattaaaacaacagtgcaatgctattacatatccatttaaattgtcaaaatccaaaacactgacaacaataaatgttgatgagcacatggaacaaaaggaactctcatccactattggtgggattgaaatatggcacagtcacattgggagacaatttggcaatattttacaaaactaaacctaagattcagcaattgtatttcttagcatttagccaaataagttgaaaacttatgtccacacaaaaactagcatatgaatgttttatagcagctctattcataattgccataacttcaaagtgaccaaaatattaatcagtaggtaaatagataaactgtggtgcattagtttcttagggatgctgtaacaaagtatcacaaattgggtgccttaaacaacagaaattaattgtaacacaattctggaggctagaagtctgaaatcaaggtattggcagggttggttcttctgaaggataatttgttccttgtctctttcctaacatctgatggtttgctagcaatcttctggcattctttggttcatggcattggctcatggcataaggactacaatcttcgcatgacattctccttgtgcctctgtctctgcattcaaatccttcccaaacctttttttttttttttttttggataatgacaagagtcattttggattagggtccaccccaatgacatcacttcaacttgatcatctgcaaaaaccatatttccaaataaggtagcattcacaggtgataaggactttgccattttaggtggggggtgcagaattcaacccctaacatagtggaatattattcattaacaaaaattaaggagatagtcaagccactaaaaagatacggaagaaacttaaatgtctgttgctgaatcaaagaggccagtgtgacagagctaactattgtatgattccacctacacaacattcttgaacaggtaaaattaaggaaagagtagaaagatcagtggttgccaaggattcagagggagacagggaaggatgaacagatggagcacagggaatattagtgctgtgaaactattctgtatgatactgtaatggttaatacgtgttgttatacatttgtcaaaacctgtagacaaagagtgaactctaatgtaaaccatgaacttttgttcataatattatatcaacattgggtcttcaattgtaacaatgtactacataaatgcaagatgttaataatagaaaaacctgtctgctggagcagtaaggggatataggatctctctgtactttctgttcaatttttctgcaaacctaaaactgctctaaaaaataaagtctattaatttatttaacaacaacaaaaaaaagttccaggttctaagtagctccattagcttcactggtcagaaggaagggcctctctgaagagacaacctttatatctgacctgaaggacaagaatatgtttcccttgtgacatgcagataggaggatttctagtaaaaagagagctggaaaagggactctgcagtgaaaagctgcatgtgcctgaggaacactgtgaggagcacagggatttcccaggggaaggcagaagaaggaggcagacagggacttgatagaacaggacttttaaaacagagtatagtttggattttattctgagtgtgatatgaaatcattggatggctaaatagcgatgtactaggatataatatattaaaataaatatcactatggcctttggatataaagaataaattgtgtatgggggcaacactggaggcaggaagactggttaggcagatattgcaatggcccaagcagaagataatactggtttggactaaggtggaggcaggggatatagaggtgtggggtgtatttaagatatgttgataaaggtaatagaagagaggacttctcactgtgtcaatcatctatgacacagctatgaatctggaaatatatggaaatatcaacttggttgcaggctgaagtccatgccctttgccattcacatcctcttccatggaatgaggactcatcagataaaatattgttttaaataaatggaccttgtgaaattgcacatgatatttgcttttcataatgtttgctgtaatagaattttactcgtatctaaaactcatttggcatagacatatttccaattttctttcacttttcactgaaaatttttaattactggagttggaaagaaagtatctcttttagtagagagaaaagttaatacaactgagcaacttgatatctttagcaactatgtaaataaatatacacatctttcttttatttacatttggtgagccacatctaaaatatatgctagcaaaactggggagctgtgaaatatgacgacaccacactgatagatatcagtcacaatctggcaaggaaaagaagggagttgctttcattttctgtttgtttttagaattattcttaaaactagataaatgtgacaattgtgccaattttttgcctcaatattttaagatgaatggcaaaaattagaaagaaaaggacaatctaatgcttaaaatatggcaaatgaacaaattctgtattatccatttctaaaggaaaagtatttcgaaatttaaaaatttttaagaaattcagcaaaattacagtagtctttgaaacattactataaaaagtagattattttgtttcctctgggaaaaactcaaatagacacaggataatggtctaatgaacaagaatgtcaggatagctaacaagtactttgaataagatataaaacagaatagtgtgtttgaattttatattttgattactcttatccatccttccattttataaaaatatggctgattcgtaaaaataattaagcagtattaggaagtatatttgctcaatgaagaagacatagtacccttgggctgttatttacagaaatgacatcattcatctttctaatccattctaagttgcttatgcgttggtcctcaatgctgtttgctacctacatttatttatccagagtgaaatagtaactatcaactgagccacactatcttcttcaaaaattccactttattcattttttggtcaatatttcacctatttttgaagttttactatttgcaaatacattgttttctttgtataaaatacatctaatgtctatacactagtaatattacttgttctcagcttcaggaaacactttacagctgtaagttgaacaaacactacgttgttaaacatgccattgttgtggtgttaaatacatcaatagaaaggagaagatggatctgttgcatctgctgccactgctctataaatttatttttatttcaaaagttcttaccaacaatttatttaaaataaacaattcctgagatttacattgcactatcccagtttcagtaatttttattctgaaggtttgcaaggaattggcatttttcccttatatactcagaagctttgcaaacactttaaaagactatataaaacctttaaaatgagaagtacatctatgtattttttaaataaaatattaaggatattaagccattgtaatgatgtaaacaaaaagtcaagcttttattgggtagttacaaaagttataattagattcttttttgttccttttttgcttaagaattttatgagttgcctgaataggaaaaattaaattaacagtttttttttccttttaacctgtttctgcttttgtgtcaatgtcaaccgggatgcgaatggggcattgtgggagacaggagaggacaatactggggagaattagcgcattggcggtagcctttcaattccagcgctgaagcaacagactgagaggaggtgaacctttaccttctcccaggcacagacaaggcgaggtgaggcagagatggattgcagaaccgcattaagcaaccgcggggtggaggagagtgcagggtgtctccaaaccctgggagggctatcttctcctttcagagcacatttctgcccaggtctttttattctcagtgcagctcgctccctggtggcttaaattacggtaaacgaaataaggtccgttaaaaaccacttctgagaggggtgattattgggggttttgaaagcacagaggtcttatagagaccaaaaatatgtgcctcgctaagatacagaaaggcttgtaagtgaatcttcataactctgggtacgtgcatgtatatgcacatatacgtatgcatgtctcgtttctataccttatataagttttctgcccaaaactttcctcgtccgtgcgttccctaccacggcgcatctaatctgtctgccctatttgtggctgcacagctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggcgctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggtaatgtgcgcgcgcacacacatacatacacaaacgttccaactcaacacaaacaaaaagatattgagagatagtatcctgatacaatgagtaggtggtggacatctaaaacgtataccttatccataggtatggagatacatcgtgtccgtttatacaatttattgacagactgtgacacagagaggggtgtgtatttacatgtgtattttcaattcagtcagtaggatctatagtgctacggatgtaaatacttactgaatgcagtcaactgcagggctcagaaggtagctcctctgtgctatgtcaacttacgaatctgctgatttgagcagtgtagaaagtttgagtggcacgttataatgtgcttttgtaaagtcatcagttgagattagtttaataatgctactgttactttgtgagaaaaactcaaagattttccctcaaatcattggcaaaaggaaagttataggtagtgaaaacttgattatatctaatgctcaactatgcacattctttaaggggaagtaagagaattctttatggaaatctgagttggataatttattgtataatatacaaatatattaacatgcaattaacgtgattgctttttaacttagtaaactattcaatttagttactattcagtttattcacattctttttataaaataatttcatccagattatatgagttaaatacattattaattcatttcttggtacatgctattatgttttaaggctccaaatatgtttcaagaaaatgtgtgtgaatgtgtatgtgtgtgtaatttatatatatatataataaatatatatataataaatatatatataataaatatatatatatattagttttggactactagtgactaagtatccaaacttaaagaccaacttttgaggtttcatataaaaaacagtatttaagtctgtatgatatcaagagggaaaactgaaattgcccaactttaatttttttatgtttgatattttccatcatggtttaatgcttctttagcatgaattattcaaaactgcaacatattataaaagcctttgattattaataaatgctatatgtaatttacatgagaaatctaagatcagaaagtacaggtgcccagagatatcactaggattcctcatgacaaactattccttcacatgcttttatgtactataaaaagtgggttgttgcaactgctccccccaacaactgtatacagtactgagtcagaactgttagatggaaaatactgtttgtataagtacttaacaattaaactcacagggttagcaggcacttgcagagttctagtttaataaagcccacattcagtccctctaagtagcaggtctgaatctttcccatttctaaagattctcagaattggagttcctgcagtctcagcaaaccactttaatgtttaacaactcacagtgccaggagaatctttcttacagccaacttaaatcctttaaattcttctttaagtctatttcatctagaaaacatacaatgttctgcctttctcacaggtattatttttcaacgctttggtaatctccgtgcctgtctcccttgccctccttttggttatggaaaactaaattgggtagggcattgtactgtttgtgccttaagacttctcagtataaagggagaattgcttcataatcttacacggtttagttctattcaagttggttagactatggtgttcatcttcccaaatctgtagggcttgcagaagaatttctgttacatggtcaaaaagtgtcctttctctcccactttggtcagtcatctcccaagagcctgactgacactatagagactggatgtgtgaatgtggatgggagaagacagcccattgaccacatggctgtgctggttgaccagggttcaccaggtactccccaccctcagggcactatttttattcactgctgggctggtttttactaaagtacaaattaatttactttgttatctaggatctacactttgactcactggaaggttctctccaatatttatttacacatttggatgtacttaaattacatatgcatcatttaaaaatatctaaattaaatgatatatgtactttctcaacactatttgatttacttggtcttcttttacattttattatggaatttgcatggctttttcaatatttgaatagtttctcatgtgagctgggcactgtatgaaaatttgtgtttattcattctctatcattggcaggtggttgagatgagtcttccaacaagttgaggtcctcttcccattacataacacttagcctttctccctaaggtgaagtggatcactaccttctggaccttagacccttacacacttgaaaactttcctaatctagataaatgtgtgtttgccttccttactaattaattgcaaaatatgaaactgtaaactgtggttatagatctttttttaattcagcaatacacattccccagttattttcaggttgacataactttattgatttttttcctttagtataaatgttaaactcagagatccataaaatacattcatctatttccttaaaaaaacatagctactctgactttttttttttttcaaatttagtgccaggaatgacctaaaattgacctttacatcaatgactttaattatttccactcactgaaactcagtttatttagtatagagatattcttagttgacttaactaactttcactaagatttccaatacttcaactttggtctttgccctttttatccaagtgtctctcctattacttttgctccacatttttctgttttattagaactgtttgcatgtagaacatggtcttaatattcaataaaacaattattggttaagactactttctacctctgctacagaaaggagaaagctacaatccctttttgacataataaggatttcttcttttgtagttctgatattatggatatctgatatctggatattatggataaaacatttcactttcctatagacataattcttcaattatataggtaaagtagttgtgtacatttatgttcaaatcacatgtctgtaaaatccaaacatgcaattttaagctaaaagtaaaaaagaatgattatatttatttcaaaggatttaatttagaaaacatgttgaatcattatatggaattgttgtaataaattcttaatgagttatttgagaaataaagcattttacccccaaacagtttttgcagatcagtaaactgaaaatcccagagtgaaattcagcttctatcttcaaagtgaaaacatggtaatgtcttttatctattgcatctttcttctttttagagactgtgtgtgaaaaaatagcatactgctttttaaacctaattaaaatgggaataattgagtagagatagtttatactactttaaatccagggacatattaaagaaagtaaaaaaaaaaaagaaaaatgagagaggattttatggtgcttaatgataaaagtctctatttttagaaactgtgcattttctaaattctaccacaatttatacctatccccgactctatctaaactctaaaataatatgactacatgatgactttaaaaatcattatgagatacacatatatacattatagacagaaaaatagatagatagatagatagatagatacacattgctatctgtgctcaagccaaagaagttttttatatattatgttatatagtcttctaccatcaaatatattaatggtaaaactttgttttaataattgggagcacttaggggacccagcaagccagtccacatgggctgctctgaaaagttggctgctcaatttaataattaaatttaataacttaatcagtaattaagctattcattgagaacatagtctatagattaattcagtgttcatgaacttctaagttctatcaccatgtttgaattcaataaaacaaatagcttctatgtaataagaaaaatatatttgacttgacttttagttatgtgatctgaaatagcatctcaagtttatattcgaatgtagtgccgttaatagtgagactatcattcgggatacctattgattacatgttaataataatggtagatatatattttatctgtggtacatatttagcttattattactcttttgaagtttagataaggttatatttcttaagaagtgcttattcctgggagcaccatagttagacatcctggaatatctttttctgggaatgcctattgtcttaatgcattgggtataaaggaaattttggggattgtcatcaaagtgaaaaatcagggtcgctgaatgttttatgttatcttatcttaagttgtatagctgattaaattggctaataggaggatgtggaatataaacaaacaagcattttaaatggaccaacaatctgctacagaattctcttgataaattacaaatgtatatctataaatgaaagaagttctagaagagatgaactaccttgaagatacatccatccatccagagaacttcttaaatgaggaaatgagtgcagttaaacccttgtcctttttttctaatgcctataatatctgactgtgtatattttcattatgcctaataaatacacattaaagactttcaaaattgctcttaaagtgatgcacttttcaagtgcaaaatataattatgaagacatgccctcctgtagagaagtcacctgcatcctcttcttgaattcatgaatgcataatactacctttcatgttggaattttcagacgttttcaataaagacgacttagttacaattcttataatacatgttctcttttttatgtcaagtatcatataaagcaacctcctttcttgtaattgcctttacagccatttcttctttcccctaactgatttcaataactttttagttagcacctatgctagttggtaccttccagaacctaaacaaatttgtgtttatttgacttcagaaagtttccatattaagaagacttaaataggtatttgagcgctataattttggcttttattagattacactacatttatttcataattgaaattagagggctcatataccttgattagtttcttttagatatatgactaaaatgaactctctgttttaggtttctgctccataatttggaactaaaataaaaatgaaacattttggtatcatgggtaggctaaatgtgcatgacatttaacatagaacttaactatttgtgacttaaaagaaaacataatgttagttgtaactgtgaaatttttgctgtataaagtgtatgcactaaaatacgtatttttatgtgttaagtaataacagagcttgaaatgccagttggttttaggctgtgttggaagcagacagcaagaacaataatatatatctcaaataactatcaagtgcctttcagtgtgaagttgattttttcaagatacacattgtcataattctttggtatatatgaacatattttgtataaaataatttgaataaaaattgaaataaaaatgctactttgcttgaaaatgcctttgggttataacaaatgtagtttttcataaaaattcaagtagcccttataaaatgacagctgaaaaagccttttgtagattgatttcacaaatcaggtttacttagagaataagatctggagagagaaattaaatatttgatatgttttcaagaaaaagtgtagttatagtgataatagtgatataccaatttccaagttacgtagtctctcttgttttggaagtactaaacttggaaggaaattctggaaaaataaattactttctaccttagacagcattttcagttgtagctaagacactctaaacttaattgaagataaaaaaacacaaaagagtattatggtgtttaaattggagcaggacctgtaatcccagcactttgggaggctgaggtgtgaggatcccttgaagccagagcttgaagccaggtgttctagaccaggttgggcaacaaagcaagaccacatttctataaaagaaaaaaatcagctgggctcagtggctcatacctatagtcgtagccacttggaaggctgaggaaggaggacagcttgagcccaggagctggaggctgcagtgaaccataataaggccacttcactgcagcccccaggcaacaaagggaaaccttgtctcaaaaataaataaataaaacataaaagggggttttgatttgctttttaaaatattcgctaatgatattaattttcctgagatgacactcagataacatgtattcaactaatctcttattttgttcaaatttgatatctaaattctaaacatatacttctgaagaactgataatatatttttctcttcacagaaaaggataaccatatagttgaatcattttcttttcttctttggctgggaggaagagacaaatctgtggcttagcaaagggataggaattgatgttggccttaaaagcaacatgatatacccttctctgctcatctcctgttcctagtccagctctgattctatttccaatgactctcgttatttttacatttatattttgctgttttaatgtacaaagtttctttcacatgacttagatctgttgtgaaaacaagttgggttgtaaatcaataataaaatattgaatgtccaaattaaggatgctactcaggattttgtactggacagcaatgagaatgattcatagagattattcagtttgttcatttctagcaagtataattaggactgccagttttctttttttctttgacaattggcaatttccttttggcaaattttatttcacttttgtgtgggtgtaagaggcagaatatagcttattttgaaatggatattgccagttttttcttttcttaaacaatcttcttcctctctattcttcttgccatcagtccttattcatttcattcacataattatcaagtttttcagcatctttttttggttcacacataaatgttggcatatacttctaactccagagatactagccctcgcaaatggtaagaactactctattctgtgcgctctttcacccaaccttacaagtttctcccctgttcaccatccacacgtaactttcatctttagttcagaatttacagctttccccatatctccattcagaacccacctaccagtgttcttcccctgcccttcttcccacagctattactcagcacttcacttgtcctgtgtacttctcagcaccagacaaatacagtcagcttcccctctttccactcacatatgtcccttccagttctttattttgctgtgaataattatgttctctaacgtcttccttggcaagcaaaggctatatgcattttctttttgtgaatgaaataaatgccatattccaaacaaaaatggccatggggcctctttttttaaatgacagggaggatagaggcatgccttaaattagacttgtcctattcatttgcttcatctgatatgaaaggaagaggcatggaggtggccatattacttgcattcacattctctaaaaacgttcaaaatccttgaataatattttaagtgtaggtgcatgatccagccttcacctacattttcagctttcactgtgtatccgtccacatgattctactattgtccacttatactgaagagttcttgactatgacatgttcgcagatgtttctgccattgcagacgctgttccctctaccccaaaaattttttacccttcatttgttgggccatatcttgtatattcttacagacttaactaaggagttcagtcctgcatttcctttcacaggtcaagtgcatctcttatagcctgccattacatccatcaattgccatcacatccattgaaatccttggggtaagtctgctgtcatccttatgtctgcaaatattctgccttattttactcaataaatatctgtagaatgaatgaacggaggtgtgaataaaaatgaatgatgaacaatatattattagattcttcatcattcaggacattcccactgatacatttgacaatagtgtagctggtatgaggaatattggaaatttccacctagtcattgacttcaatgtttagcttatgatttaaaaaccacttaaacttaatgaattactgtgaatacctcttctgcaatttcactgcaagaagcctccagaaaattggggctagctctacagtttagctatatatttatattgaaattagtgaaatttaaggaaatcttaagtacatatttaggcattaagaacattaactcacaaatatttggctaggcgcagtggctcacgcctttaatcctagcactttgggaggcccaggtgggcagattgcctgggctcaggagtttgagatcaacctgggcaagatggcaaaacccatctctactaaaaatacaaaaagttagctcggcatggtggcacgagcctgtaattccagctactcaggaggctgaggccggagaatcgcttgaaactgggaggcagaagttgccatgagccgagatagcaccactgcactccagcctgggtggcagagtgagactctgtctcagaaaacaaacaaacaaaacttacaaatactgatttttatgtgttcagtttctatgatatattatacctaaatgtatttctctctttgggtattacttctggccactgatagagggacaatattacatgaggatcaaaaatgaaggccctggagttaaacctcctattttcgaattctagttttgccattgactagtaattttataacttctcttaacttcagttttaacttcttcacagtgggaaacaatggttcctaatatggtgttttgagcctagtgcttgacattcattgagtgttcagtaaacattaacagtgattattactcagattgtgtgtgttgatatgtgtgcatgcgtatatacacctgatgttgtagtgggggaaaacttccaacaagttttatcaaactccaattgggataattatccttgtcttagttaatttaatgatttcaatagaaaataaatagatttcaatggaaatttaattagtataaatatgttcccttttgtcctggtggtaggtccacaaagaagatttttccatagagaattttttccccagttataattttttagaatgcagactattctactgatggattaagtggtcactgttttcatggcaatttttatcactttaagatctaccaagatcatttggtcaattgctttaggtataatttagtgtcacttatcaatccaaattgcagagtgctttattctatgtagcatttcagaacatcttttgctgaaggccacaagaaactgaagactggtatatataaattggtgtaatttgtacatgagttagttaagccgtattttttcattggtggcatatttaacagcttctgataaatgaattacaagttaggaacttgatcatttctttcctatttaggagtttataggaggtacataagaagaaggaaaaatagtgttttgtaatctttttcttttttttgaaagagagacaataattccctgaccaacgaccactgcagcctttgagatagcaacatcctggaaaagccacagtgtggttgtatcataattgttaagaatctccaattgcctgagtttatcagtcacatacttttcagcaaggttttgttagcaattgtcccttctcaggccagttaggatgggaccacagtatgtaagagaagcttggtcttcttctaaataataaattttatctaaaatatttagtcatctagggtagacatacagaaagaaagtaatactcttaggagtgaagagaatctgtttatttttatggtcagtttcttaatccaaataaactttttatcagttgttaatagatagttaaattctttgccttatttatagaatataaacattggaaagacccttagcaatctagattcttttaccaatctatatacttaaatatatcactatggtaggcagattaatgatatccccaaagatgtttatatttgagtccccaaaacctacaaatccaatatcttacatgacaaaagggactttccggttatgattgaattaaagaggatgagatgattatcctggatcacacagtggggtccaacttaatcacaagggtcataagagggaggcatgaatgtcagagagaaagctttgaggatgctatgcttctaggtctgaagttagaggaagaagtcacaagccagggaatgcaagtgacttcttgaatctggaaagggcaagtaaatggattctcccatagaggctcaagaaaaatcacagccttactaacatgttgatttgtgcccagtggagcttctgacctagaggactataagataataaattgatgttgcattaagccagtaagactgttaattcaacctcactcaaccttaacatggatgaatatttccaatggtgtgggagctctctgcttatcaaggtgatttcttctcctgtgagatgagtgaattaatgccagtctcctgtctctgcgcaaatgtcccttcctccttctttcttttactcactggacttcagtatgcctttttgaagcaagagtgtagggaaacaagaagagctctctgttcaacataatatccctttaaatattcagagacagctggtaaatttcattgttaagacataaaagggactgaaacatttgtgagaacaaagaacatcctatgcaatgtatatcacttgcattatttccttataagttgaaatttatgcaattcgaaatgctttactacacattttaatgtagtgcaggtttgaaatataacatactgatagttcttatattcttgataaggtggtaaactcagtacaacactatcatatattaaaaatactgttcacatttttaaatattgcctactttacccagatgtttccctgtcataccatctacatcctgtatccagagggtaaacagaaaaatcaaatcattttaaggggatattttaaggctttctcttttggttttttactcttctgcttacagatttgtgaattcctagggaaaaaagcattagttttaaataaaatgtgatgtatgaattgaagtaatagctataatttcataaaataaaaaaattctattctagacatagtggcatataaatggaaacttatttttaatttttgtattaaagaataaaataatatataaattatcactaatcatatgtgtacagctttttgatgccacgaatgtgaacagagaacagtataggccctggaagttttattttaaaaattaatattaaaaggaattttagtaaagaacacacagatttgcagctcaattgacagcaaactattgaaataaagccctcatttctgggtgtggataggtaactgcacaacgtctctgttgcttcacttttctgtttcactttgactggccaaagcaaacttactaaccacttgaaacaattaaataagagaatactgattaggcacaaatgaatggatttatgctaataaaacatatatattatatgaagagtgacatctgtgaaggatttcattatcttttccttaatattacatgccaattttcaaagatctgatcatcatgtagatttagaactgttttgcaagtggttaggaatggccctctgttgagttttcattacttgagaggagatatgaattatgtatttaatggcaagacagcaataaatgattaaaggaaagaaacctgtagcttggacttctcacaaaaatgaaatttatgtgaaaataatatgtaaactttactacaaaagttgttatacttccacaagcatgcatgaagataaaatacaaatttttgtcactatggaagcagggttattgccaagaagattgtagataaagcccaaacaatgctgatttaaatgaatttaaatagatttaaagaattgatcatgtattttaaactacgtttaatgttcttctttcagtattcatgtgctacatactatacgtttaggaagtgtgtataatatccctgggagaatccttggtgaccaccactgatgatttgctttcctgtcatcattgaaagaagatttgtgaaattgtgttacaaaaaaaccataaatcttctttatgtgtttcttccaatagtaggtcactttactgtggatttgttgttgtttttatatatcacactctgtttaaatctctatgatcatcaggatgcattccacccctgaagtgacagggcaaaccggtcttccacagggaatagagaaggtgagaaagcacagttaaagagaaatgataattggcctaaaatattcataaggagtggacttgggtggatttacatagtacataagcatccctaagtctgaaggtcttagaagtagaccaaatacatagtaactggaatacaacatgtgatctgattgtatgacaaatttgggtacatgaagttctaaattcttcattaagtcatgaatattaagctagccctaggatttaatttctgatcttgttgagtgctgtttcatgaggcaaggaaagaactgcaaactcaaaatttcttactcccgtgtttggaaacaactcagtaatacttgaccagtgtatttcaggtggtggttgctttatttttaaagctatgatatcctttgttcaaaggaaattctaggagccaggcaaaatagtcataagcagaactactttatttaaaggtggggggaaggtcttgaatggtgaaagcttcttccttttcctctgtatctgggcaggaaaggtgcttttggcataagcccagaatactttgatctgaataacacttagatggaccatgaacaggaagcagctgctgtttctaaaacatggttaaaattcatacatcttacctggagtaattaaattagctatctgatacactgccaattaattccacctctaagtgttgattatatattagtttcattctgtttgcagtttttatgaaaaatgttaaagtgactttgggagctcagccctcaggaactactgagtgggtaaattcaagaaagcacaagaaattttcccctgagctaagtgctcaagtaggaggggaggcccactttaaagagtaaagcaggaattagcagtatgtgtagcagaaacctggatatagaactaacatctggaagaagccaaagagttctagaattaaaaacaaaaatatttcaactggggagtccaagtcattcattcattctgtcagtcagtcaatcaatcatacattcaacaagtattttttaagagtatattgtctgtcagacacttgctggccatgtagcaaaactgaaagataaatcacattgtgggaagagcagatatgttttacataaaccaaataatactgggaagtaacactacttggataaatgactgtattaggtcattcttgtattgctataaagaaatacctgagactgggttatgtataaagaaaacagatttaattggctcacggttctgcaggctttacaggtagcatggtgctggcatctgcttggcttctggggaggttttaggaagcttacaatcatggtggaaggtaaagtgggagcctgcatgtcatatggccagaacaggggcaagaaaggggggtgagggagatgccactctcttttaaatgatcggatcacctgagaactcatatcatgaggacagcacaaagccatgagggatccgccccagtgatctgaacacctctcaccaggccccacttccagtactggaaattacaattcaacatgagatttgggtggggacaaatatccaaactgtatcagtgaccaaactcctttggataaaacagaaaaaagaaaaaagtgaggtaaggggcatctgaaatggatggactgagatagttatctctgttgtcatgggtcagttgactcatgcacaaagcacttaggtcagagtttaaaattaatttagatctatacaattctaaatttttatctagagacttttcaattttgctcttttgttttttaagtttttttttttttttttttaattttgaaacttcggccacctccaagtgacgaaggggattacagcaattgaaaggctcctgttaatcctcttagtttggttgtggggtgcagcctatgggccagtaccaaaagtgtgatcagctagaggctgaggggatgttctagatgtaagactgagaggaaagaaagcaatagagcactagattggacctggtctagtgtgaggtccagagtacctctttttcattgggtatctgtgtgtaagagaagcacagttggcccctgtccatagtgaaggtactgtttctactctatggaggattctctgttcctagtggtcaatgccagacatttcaatttagatgctgctaaatgaaaatatacattagaggtatctattcatcctactaagtatttattcttcaatgtgaataaaggatctggaaacaattctgttaatctaatacctcaggtgttggatctctgaaagaaaatgtgggaaaccactgaagagaataatgagagctgaagatgagtgttattgtaaggttctgctttgatggggtaggtttaggggcctctaaattgtagagaccacaaaaaggaagctcctaatagaaaaatgaggacttaaaggaaagggcactggatggaagagctctgtgctgttctttgtggaagaccctgtcaccaaagttcccagtgaaaagctctcagggggattatggctatgccttgaggctgggtggaattcagatagtaagttttcacaaacattttggggtccttactacatactgggtactgttacaggtaccggtgatagtgaagtcaacacaacagacatgctgtctgtgttagtggagactaaggaagataggcaacaaacagatttttatttcttaatgccttatataaaaatgtataagaatttaaaattcttgtgaagataagtaactgattctaaagaagaataaacagggtgaccctacctagtcctagaattgggtaagacttcccagagtaaatgatgcctaatctgagacatgaagaatgaggaggagctattttggcatagagctctgagtcaggacccaaggaatggttctttggaggttggctcagaggccgaggggcaacaagaaagcaaaggctgataggtgaggaacaaccatgcaggaccctgtaggccctgtaacaaggaaataagaaaatcatctcaagtagatagatatatggcctttaatccaactacagaactaaacgtgatcattccatagtcccaacagaagcttttctacttcttctcagtcatgccaaatgagataggtaaccatgacttttttgttgttgtttttattatttggaacaaaaatcagaaataatttataaacaagaaaataggagttccaaagttgagtcatcactaatttaattacatgtgcagtaaattcaggatccattcctgtgtatagctctataaagttaattttcagttcttctcttcttataagagtcaacagacgaggcaactctcctcattcctgaaaagcatgtatgaccactgaaatatgagccctttccagtgttgcttggtgacaaagcttgtctctttctatatttatttaaaatttgaaaataaaattgtgatgtgtgtagggctttgtggtatagtttatatatgtaagttgccttgattcatgcatttctgcatgttgtccctccaattttaaggtgggaacatggaaattttcccttctttgtactaagtacagagaggtgcttacaggtattgattttagagttggactgagctggtttgaccttctattccagctctgaccagctgtgtgactacttcaccattatcaggctcaggttgttcacttgtggtgttacttgtcttatagggcctttgcaggcagtgaatgagctaattaatgttgagggcttaacacagggtcttgcacaatagtaagtgtacaatgaaaggagctgatgattactttgatcacagttggcttattctgttaaaaacaggttttcatgactccttaaaatgttctcagtagtgacggggaacttaaaattgttgtatcaaattgttgaaattgttgctcttctggatggccctatcagatcacattatactgtagttggtttttattgggaagagaagttcaggcatgagggccagttagcatcatgttgagcacaactattgcaaatagcagccctgtgttttcacaactctcataataaaaaaatgttcagtgtgtgccctactttcctggtacagctttaattcaagataatgatacatttgtagtggcttttctatttctcgtggtgttttgtttttttttttttttttttttcagagcaaattgagttaagtagaccagttgttttcatgaacttgctgccaagtggaaggattttttctctcttttctataaggctagatatttaatctaaaactactgtctctgtgctgggaagcatccaacctcattactgtttaaatgtcttactgtctttggaaattctgatgaaccccaattagtaacccataaacccccccccccaccctgttcacttcgttatttaaaataaggaaatattagtgcaaaaacatttgtatcagtgtctagtcaggataacagaaattattctcagcttttcaaacagaggtaatccaataccaagtaattgtttaccgatgtgttaaaaagcctgagggagagaaaagagttagttgctattacccagaattagtaattgcaggaagtcactattgcccctagagctggaagggcaaaggggaaagtggtataagcagtattatgtggaccttacaagcatgtacctgggagtgctgcagctgctgctgaaaccacctgacctttgctttgcaggcatccatgagcccacagtcctgctggtgctactggactcactgacaaggtgagcgactggtgcctacaaccactggctgctgccataatgatgctggtattgcagagaggcaaccactggcctggtgctgattctgccaccgccaaaactcatgagcgctaagatgctaaggcagttggacacagaagcagaagaaaattaatcatggcttcttttcttctcctaacttccactctcccaccagtcctttcctttggaagacccaaccagagaccagctagcaaggggatctggaataggtactttactggcttcaagccagcagtttacaggcatgcagtcccagagtaaagttgaaagagtgagaatagagctgaatgctatcagacaaatacccagcactgtatttagaccatttaatataagattgcagaaactggccgggtgcagtggctcacgcctgtaataccagcactttgggaggctaaggtgggtggatcacttaaggtcaggaattcgagatcagcctggcctggccaacatggtgaaaccccatctctactaaaaatataaaaattagccaggtgtggtggcatgtgtctgtaatcccagctactctggaggctgagggacgagaataatttgagacccagaggcagaggttgcagtgagccgagatcacaccactgcactccagcatgggtgacagagtgagactccatctaaaaaaaaaaaaaaaaaaaaattgcagaaactgagaggaagtggcattaactaatgaaggaaattattttctgaatatatatgtatatatctgttatacagaaatctaaagaatgggtacaaatatttatattcaactcacacctcatgtattagtttcccactgctactgtaatgaactaccacacatttagtgaaaaaaataacataagtttattattttgccattctgtgggtcagtgtcactaggctataatcaagttataggtaaagctgccctgctttctacaggtattctctcaaaagagaattcattttaatgttttttttccagcttctagatagaagttccctacattcttaggctcattgcaacctatctccattttcaagctagaaacttcctctcatgctgccatctttatgattctctgtattgggaaaaactctttgctttaaataactcatggttcgatcgggcccacttggataagccaggatactcttcccatgtcaaggtctttagttttaatcccatctataaagtctcttttgacatgcaagacagcactcacaggtcctgatcgtggacatctatgaagatcattattctgcttactatatctcagaattttagactcctatacatctgtagttattcactggctattgttttccttagaaatctcaaacatgtaatctttaaaacaaaattactcttccaacaaatattcttcccccttggttggggacattgtcttcatctagcagcctaggcttgaagcttgagaatatttttctgtagtccctcattagattgggaaatctgctaattttcattcctaaatatatctccaatctacccctaccctgcacttctcttaccactcctatatcctgccaaggaaggcaggcattaccctgaaagtacttcttgattaatggtgcctagcattgtactagctggtggagccgccgatatgcataaggtatccatgttgtctgctccaatggaatgtgcagtctagcatggaaagtgcacattaaacaaataaatctgtggtaaatgtccatttctgatctttctgctcatggctccccagttccattttcaaaaattggggttttaaaatttctgaatattctaaagagaggacaatttgtgttatttaaaagtaatcaaagtaagtactttttgtgcatgtgtgtcacttttccctgattctgagatataaagatggcaaaaaagactactaaatgacatgtcaagtatggcaatttaattttaataaaatccagctagaatggctttagggctcatctccatcaattgttgtttaaatgagattaagttgaagattttaggcccccacactagacttaatgaatcagaatgtctggagtagggcctgggctatgcattttaaacaagtattccatgaattttttgtgcccattgacattatgaaattattgaaccaatgtcaactcatgaataatccctggatttataacactgaggccagaggatgaggaaggtttcatggctggctcactgtctgttctctcctttttccgctagtaactcctgtgaatattctctgtgaagcttccatggtgactaaatatctccctagtgcccagttcacaatcagagtaacatgcaggaagcactcactatatgccagacatacggtgctaaagtcagcctttcacgtgttgtcatatttaatccttaacacaaccttaagctggagacactgttatctttcatttgcagattaaagatcgaactttaacttcacattttactacattgcatggaagagtgctggggcttcattccagggctttcaaattacaaagctcaaatgtgaaactacttctctgagaattgactattattccctctctgtgccaccatgaaaattttcatattcttttattacagaataatggcatttaaattgttgattcacatatctgttctcctttcttcgattcccccagcaataggatcagtgtcttctttatccaagtaaatgatagccctaaggtgctacagggtctatgcgttagaagatactcaaaaaactgtccaactggtcattcattcattcaatctcagctgatttagagtgggtcaaaatgtaaatattaagtaaaagtaaaatttgggtatatacataatcaacaaaattaaaagataaaacttatatgaaaaggtgtgcaacatcactgatcatcagagaaatgcaaatcaaaactacaataagatgtcatctcactccagttaaaatggcttatatccaaaagacagggaatacaaaatactggtgaggatgtggagaaaagggaacccttgtacactgctggtgggaatgtaaattagtacattcactaaaaagaaaagtttggaggttcctcaaaaaactaaaaattagagacatactcatatcttcagcagttaatttgtatgtataatgaactgatattcagactttttttaagtaagaaattaatggtaaatacttttttgtcttttttttttttttttttttgagagaggatctcactctgtcactcaggagggagtgcagtggcatgagcatggctcattgcagccttgacctcccaggactcaggtgatcctcccacctgagcctcctgagtagctgggactacaggtgcaccactatgcctggctaatttttgattttttgtagagaaagggttccaccatattgcccacactggtctcaaacacctgggctcaagcgatccgcccacttcagcctcccaaaatgctaggattacaggcataagccactgcatgtggcctaatggtaaagactctaattgacaattacaaaaaactataaagacgctttctgagaacccaaagacatcaaaagtgtgtaaattcaaaagtgaagcaaatacttttcaacaattttatctcacgtaaactgcaaataatgatataatttgaaatctcttatctttcttcacaggaagaaataaaaatgtgtattttgcttcccttatcattatgcacttttacttattttataatgtactaattctgttcatgggtatgaatattaaaatctaatttatacatcaggcaacaaggcacagtagtattattatctcattcttttaggcacatgtagttaagcaacacatttcttgttagaaacacataatggaaacaaaaccccataaaagcgacacaagtctattttaatcttagaatttgagttctttaaaaaacaataaaaattccttcgtatgtatattaagccatttaattgaaagagtggagtaattttctgatattcacattattattgaagaatataagaagggtttccataatgcatactaatagaagttaattaaatgatcagggtctggttatctgaattggcattcaagcgtttattgaagtgtagctcatgttcttcctgaggatattaagagcagcagcagaagcctgcttaaggacttaccctgggctttgacttgctaaaacatgttctagagtatcttcagcctactgactccttgttgtagagacattatatatcagcagcttgactaattggtctaacattcttgaggtcacccagggctactggtcagaattcaaaactttttatgtccttgtcacaaagttgatcatcataactgcattatggaaagtgtgggccagcagactatatgccaaacacagcttaattcaataaacatttatggagttgctgataattttcttatatcatttattttatttaatatttctgtactcattcaatttacaaaatgctgagacccagaggctaaacaaactactcaaagtcacagttagtgagtgaaaaatctgagatttgaacacagatcctcaaatatgaaacctgggattctttctgccatgtgtgagtaggttcctttgaaaatatcctcaggttactcaggctcttattagcttcaagagacaaaaacccccgcgacactttacctgacttaagcataaaagaattaattgattgagaggactcaggggtagaaaatgtctccaggccttggccaagatgggaaaggaaattgggagctgaggtgactcattgtttatagtctatttccaaatatctcatctctgcttcttactttagtttcataatttgctgccttataaaagggctttctacaccaatttgtaagtagtgactatcccagcttttgtgtgagtgcgtgtgtgtgtgtgtgtgtgtgtgtgtgtgtgtgttgtgtaatagggcaagagaggagagaaaaagagattgggttggggaggagagggtgacagggtcacacatctgtatctcactcagggaactatggaaagatacactctgagaaaagtccatgggcagctctatcagaaggagatcagaggagggacagggaggacataattaatagaaataatctgcattatttatgcaaagcctttctcgtacagcactgttaaacactgatagttaaccccctggttcttccacttgattaggagccattttatgaatcttaattggtttctttatttcaatttagttatatatatacatatatgtatatacgtgcacatgtatttatatacactaatatctccacctctatataattatatttcaaatatgcaaatgtatgtaattttatttacacaggcattttatttccattaattaactaggagtctccttcatcaaagagatattttgatgcttcttgtagaaacacacagtgggaaaacattgccttattgtcatttataaagtaattacttatgtttatgcaaccatcacttggttaatattagcagggagaacaaggtagtgtgagaaataagaaatggtgcttctgtgagtagaacttgcttagctatggttttccagctcctctgatatggtacagtattctgtgtaaatatctttagcagcaagcatgggtgagtggtcttcctaagaatcatcgcacaaataagcatttgtgtacaagaggactcttgggggaagcatcatacttatttcaacttaatattatgtgagatcactaaacatttcttcagttacagaatcactggcacttctgcaaaaaggccaaacgtgcaaatgtcaaactgataattaccttccctttatgtggtaaaaggaatatagaaactgtggaaatcatctcattaaaaggtaatattgagtaccttcataaaaatcatcctggttaaaaataattcaaaactttgtctcttacagtttattattcagctccctcaccccataagtcaacccactaagcacgtggctaaagtgccagacttataaatacttgaagtttttgcatgtcgtttgtgctttgtgagattgtagaaagtaacagtaatgtgtggattttgggaaaaattctatacccaaaataaggcagtagaagtgtagtcctgatttcaaggggagaatgagaaagatggggactacctctagcttccacactcctattgattagtgctgtgactttgggcgcatctctacatgcttcattttcctcactgagacactgggctggaatagacagtattagaagttcccttagtgtgatgtcttcatccataatatcttagaggtatgatagtcatatttcttaaaaaatagtacattttgaaaagagatgctgatcattgtcgaaggtgagtgatgggtaaataggtttgttatactactgtcttcacttttgtgaataaaaatgttcagagaaacagggaaagagaaacatagctgcagagaatcgttacaataatatgggaatggtaaaagagtagattgaacttccttgcatcttccatcctaaaaaacatgatacgttagtttattctaagaagttactgcaacataaaatgtgatataaacggtagaacatagtaggaaatgggaacagagaagttggaaaaatttccaaggccccttgggtcattttggttgaaatgctttatcattttgttatgaatgtcatataagacatattcatagtcaagtttaatgaatatacatttaatgaatatacattacaagtttcatgaatataattaatgaatatacattacagagataaatggttcatgaattcaccatcattttggatcatgcattattgctctttaaagtcattagtttggaaaagtgagatttgattataatttgtgacttgctagcatgccctaactgggcaaaaaaagaagtgacctggataagggccaaatttcagagcaaaatttataaatacaatgtggctgatccataaagtatatagaacacaggagacaatctgcaattaactgtaaaagtttgaccatggaaatagcagtgtattaacccaaggcttgagctgtaacattagagcttgcacatattctaaactcactttctgcacagcttagtttcttctagagattagtgcaattatttatctaaacaaatgtttattaagaagacaacatgctgttcctgagctgtgtacatagtcactcggggacctttaaagtccaggattattatacactgccattcaaaactggatagagcccttttaccctggggccacaattggacattgaatctcacatgaaaggacagaaccaacctcactggaaaccagaataaagaggtgatcttccttttaccaaaaactttagaatcctaaaagtgacctttatatttttaaatatactccgcacattcactgccaacggccaagcttttggaaatactgtctatacttgtttcctcaccagactctcgctcctcaacccaccaaatcctgcttctgcctctgccactttgcataggtcaccctctccaagtcaccagtgaccttcttgttattaaacttacttttacatttctttgttacttgactttgaggcagaaattgatgttgttgagtattctcctctttagggaatgttcttttctttctctgcttttctttttctgcttcttggcaatttaaattatgttatcttagatttctttgtagatggctctttttattttccgtaggcatttctcaagatttagaatgaggctttcttctctgcttattctatatatttgtgtgggtaatagatagcaccattcctgaagtctcagtcattatccagaaattgatttacaaatcttcatgttcttgacagatctacctatgagctttgaggaaatacatcaaactctgtattggacagtataacgttgatgattctcagacacctcaaattcggcatgttcaaaacgacaaacctcatctcactccctgtgaaacccaaactgttgctcctccaatattcttgatcttagggaatggcatcttcacctgcctggtacttcatcctagactctttcctcttcttaacattctattttcagacaaataccaaggtattggacacgtctcttgattctttccacctctttctattcagtaaaggacactataggagtctgtttttgtacagacttctattatctctttcctagattgttgtaatagcctcttctcttaaggtgtatctatacagtctcgttacctagttctcatccgatctgtttcccacaattcagagtggtccttctataatgcataactaaccatagtatttctctcataaaaataaaactgctttccatttctattaagataaggtcatgatacttctttattccgctttaaatgtttgcataatctggccccataccttgctatccagcctcatctcttatgactcccctttgtacttgaggccctgccttgtagaaattctttcagttctcccaacacagtatgcttcttcttgccttcagattttagaatatccctctgctagaatacatacatatatagataagtacataaaatctcctctgccaggaacattcccctcctactccttgacttttaattggcttacttctatttaactttcagaaatccctgtgtctttgttctcttagaggcattcctgatcctctaaattaggtgaagttaggaaaccattgtaacttgtatatccaggatgacaacacttattataattgtttaatttccttttatatgtctggggtgaagggagaaagatcctgcatgctctctaaggtagaaattatgcttattttgcttatgattgtacccctgctgatgcttggcaaagtgcctgacactgtttttcagctcatccttgctgaataactaaatgcagagagaaaataaaatgtaatatttgtcatatactcccagtaccatttgagagaaatagtgggcaagctatttcaatatagtaccaaaggacaccttggcacctaaattttaattgcaaatagagtagatgctataccagtgaatttggggagagctatagagagccctttatgtgtttgtgtcttccatagtccctaggatatgactctgcatataatgggcaatcaataaataattcttggattaatgtttgaatgacttttatttgactaaaggaagaaattaagctcaataagcactgctgattttttttctctttactgaatgcagatataagattaaggggagatgtaggagatttcaggctaagaataatctttgggctaattcctcttttagcttaatttattttaatttatcaaactgcttttattctgtttttctttcctaggagttcctcacttatatcagaaaatactgttagtgcctagctatttcaacaaagaataaaatttaatataatttatatgacctacacctcatctaaagatagcaatactggagatatccaaccaggaaggagcaatttttgcttgataattccaacaaaaattgtttgatttccatttcaataatgaaaatattgataatggcctgtttatgagattgcataacacttttgataaaagtaaaattaaccttatggaataattcttacagatattttaaatgattcctttttgtgataagacactaaatatacaaatgaaaaaaggccatggcaattgtttacaagttgctggcaggaagatgagtgtgcacacaaacatggcagcagaatttctagaatgtggttgagtaccatgtacagtgaggacagaaaaaagttccttgagtttgccagtcttcacagaggacataatttgattgctaagcagaattttgctaagagaagtgaggaagggtgatagaagcaaagagcatggaaaaattagggaactgttagagaacaaagtgtgagaaaagactatgagaaaggagaaagagacaagagaaaaccataaggtgaatctgggtagcaaagtaagcatggatcagagaatcaaggctttgcagattatttattatagaattttgctttttatcctgaaggtgaaatggaatccattgaataattttgatcaggggaataatatttattgagtgctgactatactcaaattactgtgaatttacctgttaaccaaatagtgaactctgtgagtaagtgtttatgcacacttctttaaagatgttccttctcattgagtttaaaggccttattactaggagtttacatatatatatgtgacagatgaatctgagaatattacttaaaagatgaggtttgcacagttttgttgcagtgaatttaactgtttcaaactgtgaattctgtaatgaagtgtttaaacgttcttcaaagatgtcaccatatgatgggaactttacaccattgttttatgggttaacaccaataactaatcgtaaaatacagatcctgttatcactctcattgtgcagatgaggaaactgaggtacagaaaggtaaagaaacaaattacacttctaaaaagttgtagaacccggtttcagttcagcaatttgacaccagagtggctctcttgattaaaccttctgctatactgtctttatgtttgatagaaacatgacataactgagaagagagagtaggaagaagaaattggagtgaggaaaatgcctaagcagggcacagaaacaagatcagacaatgggaacactgtggaaaacagatgaggattggattgattggctgtcaatcataaaaagaaagaaaggaatctaggataatttttgaatttctgacttagcagccgtttggagagtggttcattttatagcaacaaagagggtatagggaggggtaggttgaaggaatgtggcggcagggaatgatgcattcatctagtgcatgtggaggtgcagatgcctgtggggttccagtgggacttcttgagaaggccctgcatgaggactggaggccaggtggaatttggtgtagtagtgaagaaaacatgtagaattaaatccagaacccctaatcatggcaacaaggccctacatagtgtaaccctggccactgtcaccaacctcactcccctcttgcttccagtactctggtctctctggtattccttctgtccttcaacacaccaagcttgctcctcccccagagcctttacacttgttgttctgtcatatagaatgttctgaccgttaccaccccacctcttttcattcagatctcagtttgagaaggcttcactgaccaccgaatgtaaaccagacccattagttactgtcaacattatgacttttttcatagcacatgaaaccatctgaagtcattttctctatttgtttatttgttttttgtttcctcttccagagtatatgctcactggaaacactggccttgtcttttttaccattgtatcttcagggtgtaggcaggaatgcaaacaacatagttgtataacacatatttgttaaatgaattaatgaagatacaaacatgtatttgaagtcattatctcttagatgggagttgaggtcatggcattaattagaatgaattagagaagtgtgcaactagagtgatcagggaaagagaagaatgccttgacaacactattattctcttcatatcctctttaaggataaatggtaatcttttcaactgaaattacaggtgaactaattctataaatattcacattcagttaaaaatggtttctttttcatttgaaatttatatctacttatgcttaaataaaatatatttggtctaaattgtatggaaaatctcttttacatttctgcctatatagaaacatactagcaaaagtattttaataaatccaaagtccaaccattgttagaaattaacaactaaacaaataaccaaaataaaatgtatcaaagttggtctttcaaaaatataagaaaacacagaaatggtaataagaactagtttttttgtatagcaactcaacatgaggccagctaatataaaatttttctcagatattataaactgtccataccaataaaaagttctaaactaatgagaaaaagtgagtagacaggcataatttgcttaaagttacttacttgtagaggaataaaggtctgcataattaatgtggtgaagttaataatcacaagaccctaaatgggagaatactgttatcttgcttttattgttactgttgttacactgttataccagtatactgttacatttccttttaccattggcaaaacaccttaatgtctttaggtctcagaatctttatctgtggaataagaggagtcaaacagatatttgaaaggtactttttgggttctctctgtatgctcttaaaatctatgcactgtttttactacatacatcctgtccacaggtaatcaggaaatttaagtaactgaccacaagggggagaactttaattctgcattaaattatttaatacaatatgaaatgatttgaaagtacttggctatgtgaggttggtgataggctgcttcatttccacttccttgtggaagttggggcattctactgctaacgataggtttaacttaattgaaatgtggttttgtgtttgtagagttatgatacagtcactggatgtcaaattctatttgtattaagcaataatgctccatgaagggatccagatgccttttttattaaatttatgatagtagaatgttagaattcaccctggaagagtttttcctttcaagtaatattatttaagttattctgcaagaaatctattaccttcttgaatgtcaactctgaaacaagcataggattatcaacggggcagtctgtactcaagtattcatataaaaagaaaagaattagaatggtgctggccacatcatttgaatgttatgtgatcattggctttatatatatgttcgctgttatatgaatattaaatattatatgttcacactgttaaatattcatttttctgtgggttaagttatgtactcttatttaaaattttattttaaggcaactatagctttctttatttttaaaatattttatttgaagttccaggtacaagtgcaggacgtgcagattttttacgtaggtaaatgtatgccatggtggtttgctgcacctgtcttcccatcccttaggtatcaagccccacgtgcattagctatttaccctgatgctctccctccccttgcacccctgacaggccctagtgggtgttgtttccctccttgtgtctatgtgttctcaatgttcagctcccatttataagtgagaacatgaggtatttggttttctgttcctgcattagtctgctaaggataatgccctcccttctccatccatgtccctgcaaaggacatgatcttgttcctttttctgtatagtatatattcatagtattccatatcacatatcacatatacatatatcacattttctttatccagtctatcactgatgggcatttgagttgattccatgtctttgctattgtgaatagggctgcaatgaacatacgcgtgcatgtatctgcattctattataactttcattgagttaagaattaccttatcagtcatactaaggcttaaaagtttacattttggatttcattaagctaaatttgtaaggtataaatgtaagatttctggattttatcaaatgtacccaaacatacacagctaaatgagtccaatttaaagacattatatcagtgacctatataagtatctcaataactcatttgttactgaagacaatttgtacttccccttagaagcattgtcacgctctttttaatatgttcagtgacagcagatctgtctttgagagtgagtataaattaaaaaaattctatcaatggagatcaaatcttaaagttactaattaagttggagtataacaataatttggagatcaaaaattagatataattaaaatatttaagctccctttgatttataaacctcctttattcaactgccaaagggtcccaaaatgttttcagcaatggtgttgctacctggacaaatataaatcttcctgaagtgactcctatacggggtaaatttatttgaatacattcattctgatgtgttcacaaaaatgaacaaataactatataaatgaaattgtttatagtcacactgtgtttattttccagttattttcatagtgagccttcatgaattctttaaaattacgatatgctaagtaaatcagcaattttatcgttgagagatattctataacttcttccaaaaatgattaagattgttaataattctctttttggcttagtgaattaggtttctattggtattctcacaccaaaaagtattatagacccataaaaaatctatgccaggcagtgtgttgaatataccccctattgctacttgtacacccagtgactagcacagtgattggcctactagtacatttttaccagtagctatccaataaattttggtacataaattaatgaataataagtgatacaaagagcttatacacgtatatattatttttcccattacatatgtattatttttccacagtgctgcgtaatcattcacccaaaccttagtggttaaataaacaataatcactaatgttcacagaactctgatttgggcaggactcagtggaaacagctcatttcttctccacacaatgtcaactgagctggcttcccaggtttactggaagcctggggtctggggtcacctgaagtctcactcactcacatgtctagtggatgataggggctgttggctgcgaccttagctggggatgttgtctgaaattgctggattgctcacagcatagtgtttgaattccaggagctagcattcaagtgagcaaggcaaagtgcacatttttatgacctagccttcgagatcacacggaataacttcttttgtattttatcggttaaggcagtcacagaagaggtctgcctgcattcaaggggagagagttagaagccactacacaatgggaggaatatcaagctcatgttgtaagaaaggcatgtgggattggatatattgcagtaaccatttctggaaaatacaatatgccatattttctgatttataaatatataatttttatccaaaattcaaacttctattcactagataactttagaaaataatattcccaaacaaaattcaccctgctaaaggaattctatctgatccaataaacatttattatccattattctcttacatatgctcgtcttctctcccaaaccactttcacattcatgctaatcctggaccaaggattgtatctttgttgaacgttttctctattccttttttgctgggaaaatatttacttacgtttccagtcagtttatcactaatcatttactattgacatgcccctgtgtctttttcacagttcaaagaatagacagcataatgctgtttaatattaggtgtttttttctaaattgatataaattttgaaagttatatactctttcttagctagaagaattctcattttatcttaaacatttttttctgttactaacttgaaagaaacttcagttaaaactgaaaaataccattctaattaatgaagtattacaaaatttggaaaatagaatggtcttccctaaaatttgattctgttatgtaacaatgatgcatatcatttttgtttattatatacattttgtttgttacatacaatttggtcagtattttcatatgcagaacaaaattttcttcaaatgaaaaattgaggtgcacactgagattggtttgtcctcaaagaagctaaaaatgaaaaaaaaataataaaaaataaaactataatgataagtattttctccattaactccaaagttggtttcgtaagatgttaaggtgatttgggacaaatatcattgcagttttcaaaatattgatgtcaattaattgtttaaacaagctaaaaacttttaaacaatgcaaaaaatattcatctggataaaagaagggatcaacttgaaattggtcacatagaaattatatataattagttgctttctagaaagtgaattgagaaaataaccagattgtttattttacataaaatcatttagaagtaagtgttaatagtgggcagataatgttttctgtgtaccctgccatattcctcagtgcctggcaaatgtttgtaacatagagggatgttcaataaatgatgttgcatggagtagcacaatgccacctgataatgtattttcatttcattccgaatagctattgttttctgtagctttataatggtctcaatattcttgattatataggccagaatatgtgggctttggaaatattttcaataattagattttgttttctgaatgcaggaattatacagtgattattcctttacttgtgctctcaaagcccttcctatatactgctactataatgatatattatattacattatatgtcatatcgtaactacttctacatgtacttgcctctaacctgaggttgcaagcaactcaagggtgggatttttcttctcgattttgtaccctcagaacactatacttctgctatgtagtagtgactgtttattaactcttgagggattggatgataatctgaattccgtttgtcttttttcagccatacttttttttgaaaagtgtcaattcatgaaaatgatgttaatatttgagagcttatgataaacttattaaacccatctacctagtaaaataatgtattgaacttaataccacaacaaatagatacattttaaagtttagctcaacatactctataaagattaatatattacctctgtgtatattgcaatgttctgtttcttttaaaagacaccagtaactttaaaaatgttttttttatttaagtagcacaaactccttaagagacatgggcacattatccctctcaatcctagaaacgtgaaggagcaggccataccacctcagaatccagagtgatgtgtatgggtctattatacatgtttataaatgttgccgggtccatgaattcttcggatttgcacaagtactttatgatttgttctgggaggagtaggtcaggtgcaacttggtgtaagttatcgcctggtcctttagtgcctactttcatagtctggcaaaggtagagtgacagtttatgagtttgtgtgagaaaatctgtgatgacctcctttagggactgtgactgtgtcacatcgtcgagatacataactggaacttttatcactgaaacatgccattgcataaaaagcctcattggaatgttatgagaaatgactataattttcatttgttgaataaaaaatactgtttcatctttgacatggccaatataatctaaaagaactttgtagagagtgtcgctggaggactcgaggatatgcagaatggaagtgggatagatgagcagcaatcctgtcactgcttctcctaggtgatgtttcaaaactgactgaaacatttgttcatagtagtcagcaacatcttttctttctacatttgcttgtatcttggccactagaaacatcctatcaagaaggaatttctttaggtgtagtcgttgtttctcttcttgaaagtgcaggtaattgctacgtgggacttggagaaaaagaagaggttccagtggcaaaggccttttgctgcccttctggttatggaccgaaaaggacatgaggagtcttatttatttttccagatgattccagcttttagcttatcataatatttatgctgccagggtacctctttactgatgaactcgtgtttttatttcttctgacaaaaaaaaaaagagtaaatcacggtttgtcaaatgttactaaatagtaaaatcccaatcttttgccagttttatcaggaaacaatgtatttgaaatgaaagacaatgttaaaacaatactcaaactatagacttttttaaaagtttacaacgaaagagttaaataatatcctaggaaaaaactttgtaaatgtcatgtaatggtgattacagattgtcctttataagccaaattttttaaaaatggtattttatggtaattcttccagtttcttttacaaatctaactgatctataacttttaaaaaaaaatccaaggctttttaagtcctaattagcttatgtaacctttagtcatgtcactaatagttaataatgttccttgaataataacagtaaacatttcaagggaaaagttttggttctttgttttttctcctatcgacgaatctcagaaatgattcatttctcccccctttatttgttttcttgttgtttttgttgttgtaagggctacatgaaagtattctgctactttaacttactctgcttacaaatctcctcaatttttttttccaggtcaacttaccatttttcttttttttcctgtgcttctgtcacgcacctgtcctcgaggccctacttgtcctccatcaggctcccaactgccagtcctctggtgttctcagctgtcctgtgttctgccttccctcgggcatacgtgagtcagaatgtcagcaccattaaaggaccagagcgccaagtttcttaatacgggtatctcgacaaacacttcaaagtcactgcagaggaagtgtgaatggcttattcctgaatggtttatttttagtcaggtgcatttgtaagtcagacagatggtgagaatctggacatctttttcctttctttttttccgtttgataaataaaaagtatggttgtagaactcctctgttctacttagacactaactaaagacttcaggaacacatatctgaatctatctaatggtgaatatatgatgagaaagttctatagtaagatttggcttacttaacttaatgtgattttaagagatgcacctcttaaaattgtgtcttaagagatgcatctcttaaaattgcatccacatgagttctaaacagtaattttaaaacaagtttaaaaaacgtttattcaatttttaacaatgaaacctaagaataattttttccctgagttctgtattatccaaactaatgatctaattttaatgataatacaatgataaattatccaagtaaatgaaggcagagaggtgacttaataattaattaattgtgtaatacataaaaatggactattcttcctcattgtgattcactttatcactccctgaagcaatacaatctttccgaagatgtaaaccatggtgccaaaccatgtcattgcccagtctagttattatctcactctcattcttcttacagctttgttggaagaaagtgtccatgttgaccagagccttcattatggccttctctcctctcctggtttctatgatactgcactttcttggatttctttctaaatctctgtatgaggccttgcccggcaataccttctcacatccaactctggaaaatacttaggctctgcgctcatgatgtggttggatctctcgctctacttctttgcccagttagctcagcaccatctatatgtctcttttgtgagggcaggtaagtggtccttaaagccactcttgccactagattgcacgtttgaaattggaaattgatcatggggctttccttctgagcttacctgtggactaaaaatatttttcaatctgagtctcaaggtagacacaactagttaattggggttgagaaagaagaaaaaactgagctcccattctagattatttttgcacagaaaattctcaaattattatctccagtcacttattcacaactcttctctccttggatgtaactctgtcttttcaaatttaaaatgaaaacatttaaacaattattttccttattaaacatgtttccctttacaaataccccacttgtgtctaaattaacatgttttttcctctcagttcccaggccaaaatccttggtattatttgttcatgtttcatccaagttatatactccaactctattctttttactaagtctttttactcactttaatatgccttaagggttcttgatttacactacctctttcatagtcctacttctttatttggattataataagggtctctacccacagtatttctagatttctccaccccacaaattcagctaagagtgtgaaaccataagccctttgatacatctactttataaagttaaaaagattctcattttacaaagtcctccctgctttctttccctccatagaatgctgggaggcaaagcctctgccttcaccacatccagagtgacttctggtatttatttccaatttccagtcatggattaaaccagagagaacatggggacaggcaatggtgtgatttgttacctaacacagctactgatcaaagtcagtaggagaatttatgaggtactgctacccaggagccccttttcagtgcacaaactcaaactagtcttttatacacaggtgagattcttcctcttcatgaaactgttccttactgacagcccaatttcttccctaacatggctgagaactatccctcaagataaggctaaccccaggatgtactgttccacctcaactttctgttgacttcatttacatatttttattataattatgttctcaaaatataaagaattgccacagcaaatgagagtgatgtactatcaagttttgaacaagattgttaactcaccttgtcagtttcccactatcttcttggattccctgaatctcagaataaataataaaaactatttcatagttctgcttgttttatcttctggctttgctcattctcctccaggtctagtttttgtgcactgctttttccaaatctcttttttaagagttctatttccatgggtatcagaaccttgatggcttcccccttcttctaaatcatagctccccactctgatcaatacttccaacacaatatctctctgataatcacatgtgtctttctaccttttactcctatcaaaagaagcttagtggtcatcttttctcaccatgtgtgctttttgttttccttttatttcatatatctagattcctccaatataaacctaatagaagaatgatatttcatcatgataaacatataaactctatagaaaatcaactaagctctcctttcttcaaaagagtgataatatcttaacaaagcctaattgttgttatcttgaaaaacatatgaactatcatttctgtaagtcaaaaaaggcaagtagagacaatgttgcatggttcaaactaatacattcagaagcaatagtttttaatctccatggatggtttgacatctttattccattttcccaatgtaattttccattttcaaattatttttttgctattgggttgcttcctaaaaattttagcttcattgtcacatggctatctgaaaggtttaaaggcaacttgttttcttatcattcatcaatcacactctgaactgtcaagagtaagttctgactagatagaaatagaagcaacatgcaattcagacagtttttgattcattgtcttgtgtaattagaattgtacactctctgctcaatggacattcagctttaagtgcccaggtgccacaatccttatgtgccatctattaagggcaagttatttaccttcagatggtgactcaagagaactcttctatctgtctgtctacgtatctggataaagaagcatttgtgttattctacccagagtgatctgtttagaatagctatccaagttcaagttcaaacaactgataagtcacagaaccttaatagaagcttaggatgccaagtcttctttcaattattctacttatctacctttttaattcaacttatctgatgttaatacatagcatatacttgtaactcgtgtcaaagagtacaccttactattactgatatacttatgccctggtttcctttttcagaaccaaatgctcctgaataacaaatttatcatgtcctttttgtttttgtaagccagacagaaaggattaaaacaattaaataccatttattatttaccatgtgccatgcactagatacttttacatacagtaactaagctacttttaacagtaaccctatatgatagatagaatcttttctacagtttatatgggaggaaaccaaaatttagagtagttaagtattttgcacacaattaaaatcttctctcagcagcctccatattctgtctacctgggtaaagaggaggtaaattatctcctatttctatccatgaccatagtgtcattcttccccctgtctatgagatgattcctctggaaccaaaggataccttatggtttggataaagtaaatttaaagaaaaacttctacattatacctaggtttcagcaacatttatctactgttattatctactcatttgtctcagatttattgacgcctttggtgtgccaggtgatatcattaggcactataagaaatgtaagtctggagcttagagtccagatttcaggagcttagagtcaggtacaggtgatgaaatgtacatgaatctgagatgttcttgagacagagcagggaaaaacaataaatatcatgcaaatgatgtttagtgctttagaaacaccaatttagaaagggtaactctggagttttcttagaaacgttagtgaaagagttctcatttgagcgtggccttcagagaaacaggattgaaggacagcctcatgaattggtctcacatacattcctttaaaatgtgaggttgtgcacttactaaacttgatttccatctggaataccaggctttaaactctcacctgtgctcaggtcctagcgaaacaaaacactctaaatcatttcctttcactttatgtcttatatcaaaatgatcagccaaagagaactaatcatctaaataaatggcttacaacttgggtacagcctttcactaagagcacatataataagctattgagtagacaaaaaatatatttgatttagcatagcaaatctgagtgagcttagttatcaaatcactaggtatttgaacatttattgaaaaagacattccccctccaagaaaaaaaaacaaactacattactttctctggcattgactctcttcaccaatagtattacggaacagtgtttggtaattacttatcaaggagagcgcaggctaggaacatttagttaattgattacaacatttcacatagttttcatctatttactatttgtagaaaaatgtgccaggctctatggaaatattcttgtgaatcagatattttatctgcacatgaaaaatttaattctgttagtagatcttaagatccccatgactatgtttagtacagggctggatgggcgtatacaagagtgctaagatataaacaatgaacaatgaaagcacaaaatttggaaacatttaaatttggctggaagaatgagcatttaagctgggaattaaaaaatagatatgatttgtgtgtgtgtgtgtgtgtgtgtgtgtgtgtgtgtgtgtgtgcttaaagcataaacagcagagggcatatgttaaagataggaagtgtggcacaccattaagaaaatggaaacaatctgttctggctaaagcactagtcctcaaaccacagaatctgcaaatttgttaaactgaagattcctggtctctaggccaaaaatgtctaagttagtaggcttaaagtgagacccaagaatttgcatttttgacaagtaatctcccagtctctctacatacctcactttaagaaagaagaggctaactcacagtgattcaaaccctgactgtctattagaataatctagtggagaattttttattttattttattttatttccataggtttttggggaacaggtggtatttggttacatgagtaagttctttagtggtgatttgcaagattctagtgcgcccacccagcaccccaaaagccagttcccagtcttacttaattaggaattccaccaggaatggaaccctggtgtgtagtttgttaaaacctctccaggtgattttaaatgtagcctggagcagaactgctagaaggtgagtggtgggaggagaggggaaaaaaaaaaaaagtaacttggaagcagtttgtggaggacttctatgccacgctcagaagtttgaattttactccgtggataatagagaatcatgagaatttcctgagtgcctgtaattataactgtttaggaagttgccctgaagtgcagaggaattggagatgggaaatactagaggcacccagagcccttttaagaactctgcagttggcaagtgatccctcttatcttctgccagcttaacagtaaattgtttcaactttgctgaaaaccaatttgcaaatgtaaatcataagcttaaaaatctactctttgactaagtaatgcctcttctagatcccatggtaagtaaataaaattatgagtttcacgttgaagctaagtgaagaaaaaattttaaaaaagaaacaaaattactgacaaacatttgaaatataaagacagtttttatagaaaaaaagaactttgaaaaaatgaatatatgtattaatgaacaactactatgatgcccttgaaattaattttgaagaatatttcaagggaggaaaaatagttattcactgaaacgaatagcataatatgaaaaattatagatatttaaaaataaaatttggatctgatatggtttggctgtgtggccccacccaaatctcatttcgaattgtaatctccatgtgttgagggagggatctggtgggaggtgattggatcttggggcagtttccctcatgctgctctggtgatagcgagggaattctcaggaaatctgatggctttaaaaatggcggtatctcctgtgctcgctccctcccgcctcaagtgaagaagctccttgttctgcttcaccttctgccatgactgcaagtttcctgagacctcctcaatcatgcgaaactgtgagtcaattaaacatcttttgtttataaattgcccagtctcaggtagtatctttataacagtgcgaaagtgaactagtaatatctttcttcaggcacaacttttttctgttttgtttttaaatcagtaaaagaaactgggtcctagaagctacagtggtctaagcagcagcaagtttatgcattcatttttgtttttgttaaaatacgttaaaattgtcacactgctggcacacctcatttgcatgaaattctgtaccacacttactaattgtagtaaagtttccccctatctcagggaaaagaaaaaaaactactctggaatgtaattttctctgagatctaaccgaactttgttaagtggattgggacaagattataaatgatatgaaaaataacattttgacatttgtccatcaaatttaagaaaataatttgcctatataatttttcgtaatttttttaaagataatatattctaccctcatgtggttctcagatttaaaccataatgaacaggaaaaaaaaaaagggaaagaatgcaactgagtgctaaggcagaacattgtggcagaagaaattaatgaaggtggagtatatactgaatatcaagtgcagaatttcatagagcaaacaagataaccgtctatatttttcacatatgcaggcaaagtggattttgcaattgccagttacgttaaatgcactaaataaaactcctaacattgatactataaggcacccccttaagttttccagtctgcaactgtgcataattttaaaatgtttttttgaaaaacattttaagtttaaattggattcccaaccttatttttaaaaagtcacagaaacaagaatagagagaaatctagccatgttttaactggtagaatttcggacggatatttgttttgtattttccaattttttcaagtgtgtctatgttattatgttcagaaaaaaaaacgttaaaaaataaggctattgcaatggtttggtgaatgatgatacatgtgttgctttgtttgtaagtctaggatagtctagcctgagagcctgctattgagtagaacttgtagaatgatggatcatgaaccaaattgaacaaagagaagcttcactctgggaaatctgtacctaccaactaggagtcaagataggaaaatataagggtataagatagggaaattactaagaaacagtccaggaattttagtccagacaccttgcatactactgagtaaaaggtgagtctttaaagaatttgcaccagttggatacagtctgaactaaagcagttgctaagactgaaaatgtgcaagccatcaccaaggtagacaagacctgattcactggatatgggaggttaggaatgcaaggatttagagatgacactgaaggtttgaatatcagttactgggaggactaacattttttctttaaataaagatggaagatacaggaggatgcccagatttgggaagaaaaatagtttgtgtagattatcttgaagtggagtggccatggaaatatccaggtatatatgtaactgtgaatctgaagatctgaggaagtctggacttatgatgaaaatttggtagttgtctgcattgagggtagaactgaaaccatgggaaacaatgaagtcatgagatagtgaaaggaaagaagaaggtggaggagcacattatggaacatccagttttagggagtaggcaaataagaggcagtgaaagaggcaacaacaaatcagaaataggcagagaattaagaaaacacaggcttatgaaggtcactgcaggagaaacgtttaaaagttggtggttgaggtaaaattctaaacaaaaataaaaaagcctaaggactggggtgaccatttaatattggcaattacgtttactagggatttaaagaaaaatagatctggtaaaatagttgagcaaagccaggttgcaagcattgagtggatcaaaggagaataagtggtcagagggtcgaccactcctccacatttgtcagtaagaagaatgaaagcactctgatagtaaactatagaggaggaagatagtagattaatagttgtatagtaatcctaggtttttacctattaaaaactagcatgctgggtttctttttgtcttttctatcattgtgtccagccaggaaggtggaatctgaaaatggaatactgtatggtatgcttcgaaaataccttaagattgtcagcttctatacagagatttggagactacatataacactaaactctcagttatgtttcttttatcttcttttaatcagttttttttcagcttctttgcaggacagaacactaaagctttatgacttaactaacacacagtgcacattatgatgaggtgacataaacacaaatttgaatttatttttttatgacttaaaatctttgtgtaatagcaaagttgctttacacatacaaattttattatgattggagtaatatcttcacaatttcattactcaggcccatataacctattatgctaaaatgtgttatcgataagctaatatctattttagtgcttccttttggttcagctttgaacaattgtcacatggaatggagaaaatttgactagtagaagtttagagctggaggggaacttggtacccctgacataacatactccgtttgcaattaagaaaaccatggcaaaaagagatagatattactgatttcaagttgcttacttgtaaagttgccgaaaaatgtgtactcatgaaatactaaaacagggagataatatttcacactagagtattttttaatatattataaaagtttcagtggataaagtggtgttagagctattctgaaagaagttgtaggaatctgaattttatgacacttaatattgagaaccattaaatgttttaagcagtaaagttatatgatgagttacacatttaatggtgactagttttgggaagacagaaattttatagtcaggtatgccctactaaaacattattgtattccaaatatgcaatgagggtctaggctagaatttagaactttaaaatgtatttctttttaaagtaacagcaatattaatccaagtctaaataacatattgtttttattccatgtaactagagtagcagtatagtaaaaacaacataataaaatatttttaaatattagctatgtgctagatgcctaagcagattgcctttaatttatccaacaagcctttattatcctgaaaccttcccagcatctattaaatttaaagccctttgtccattttaactcaaggtacctccacatttctttggaaactgtacctactaacactagcagttgtggacaattgagagacttatgtatcactgttttaatatatgtgaacataaggtacgatcactttttttgtgaagacaattttgtgaaaatataaaagggtgatgaagtagagcacagtgttgatggtgcctgcttcattaaggacagcacattcctgggggtctagagtaagaatgcagtggtatgggaagtataggcacctgtcctccatcatcatcatgaatgcctctctggtccatgtctcacctgtcattatagttctttgtctcaatgacaagtacctcttaactacatatgtgccactgttggcctcatggaaaccatttcaatagtggtacgtgttccaagagttcccaggcaaagctgttctgggctctgtgtgccttgcgtgctgaaatatagataatagctttgtgcttttttttttttttcctaactcaggaagttttaagtgccacattttgtaagatagtggctgatctaactatgaggaccttatttctaacccattgatttagctagtaggaatcattatttctatgtattttctatttaaatttttaaattttaaattggctatatccctcccactgttcagttgtggtatactcagaaaaatctaaacattaatcatacaaggtgaataaaagcataactataaaggcaaagttctcaaaatcatataattagtttcagagtcaaatattaaaattatttggattacccagtccttaaaattgtcaactcttttagctatacaacttgagtatagattgcagttgctgtgattatatttgctcctaattataatttttattaaggatagtttggatttaagagaggccacacttttttggtttggttttctgggaagagtaactttgttttaatcattaacagagttgcaagtgtaagttaactttcgtatctggcatttactctaccttaatataaggtagagaaatagcctggcctagtcattgttatatgggttaaatctctcatctgcttctcaaaataatgcatctatctaccatggacccacatttaatgcctatctcatttgaggggtgtgtgtgtgtgtgtgtgtatgtgtgtgtatgtgtgtgtgttgttagaaaagttcttaaaacttttcagtaataagccattatcatagtagaaagaaagcatacttttaagctttgcctcttgagcaaactgaaggcccattttagatctcaggctcacagggtccagggaggtgatatttaataagtttctagaggttaaggccaatggtgtgacctgtgttcagtgactcattgttgttagaaatttgcctccagtgatctatttgagaaccaggctagttttacattttttataaggtcattctccaagacctatgcctcttaaaaaaaggaaaattcttcacggtcatattattatattggaattcaagtgcaggtctctggcctagtgtatatcttctctgccttcaaaaaactgttttctttgtgacttaaaaaatgaaaaatccatatcttttttgactgaagataactttatacttttaacctatatttcagaaagccaatctttagagaaaatgaaatattttaagggaaaactaaagcatagccatgctctgcaaacttttaaaacattagtttcaggctgtgattgctgttttctatttgactttcaagttagttttaattggcataattttactatttaatagttaagcatttttttaataataagatataaaggtgaacaataaaaagaacaaaaataagtttatgttataaaaaataaaattaaagaggaagaattttgtatgggtagggtgatggcaaagtcaaataaaattcaaccacaccatacagaagagctagattaaatcttgaatgctttgtgttacgtgagtagaaaagaatgatcgctctgaatactttataacctctaagaggagagaatgttgctgcagcaatatctgggaaatacaatcagtgtgtctgaagccagcatctatttatcttaaattaatcatttttttttctgagtaagtggatgataatcctggtgctgggtgccagtgtctttttattcatgccatagataaaactagagcactcctatgttggtgagagctatacaatacaaaaggtctcaagctgtaactcttctgtaagattatagacagctttatagatttgcaacatgattttgggattgagaatcagtaaataattgtatctaaagtaaaatcttgtgcataatcaagtctattttacctttctgccctcaggaaagtataaacaaggtattctaaatataaggcagtaatttttcttcttcattattaaattctctggtcaaagaagttcctacaactgaagtggaaaagccttcactaaattgtaaactgtctggttgctgttagtgtgagccatagggtgaagagcagcatggtgcctctgatgcagtgaacctcaaatgacaccacattgaaggcccagcaatcaggcttacattcaaatatgtactcactttatctcttctgaaaagaaaaccaggccaggcacggtggctcatgcctgtaatcccagaactttaggaggctgaggcgggcggatcacctgaggtcaggagtttgagacccgtctggccaacatggtgaaaacccttctactaaaaattagccaggcatggtggcatgcgcctgtaatcccagctactcaggaggctgaggcaggagaatcacttgaacccaggagacggaggttgcagtgagccgagattgcaccattgcactccagcctgggggacaagagtgagacatcatctcaaaaaaaaaaaaaaaaagtaaaccaggaaagtagtctggatttttttttaagtaggtcttctttcctaggcattgtcagtaagtattatattatcatcttgtctagggtagagggtagagtagcaagaaggaagtgagatctcctcacctctaaattgaacagtgtactgggatttaaccatcttctaactctcgcattatgtctcaagaatatatgtggatatacaaatatttgtcagtagacattagacattgtgattaaaagctgtgaaaaatatgtaaaatacaatgaaattttggtcctcctggaaaagcatctaaaaagaattcagaaaggaatggagcaatgactcaacatatcagatttagttaagtggtactgatagcaggatgaaagttaacctaacttaaaaattaggtaaggctatgtggcttataagagttaagaactcaaccattggtaagttatgaaatcccttttatagactatgcatagggctcaaggtgacccttagtcacactgacaaaatagtcagcaactgggttgaaatcccagatcaatatagatcttcaattggctaagaaggtaacctcaaaactgtttgtagtgatatcatttccttcttagataaaattcttttaactctggaggatttgtaatttatagtagaagtatctaaaataactaaatttggcagcatatttttgtattaagaggaggtgtacacacttggtattttaaggatttctaatgtgaaagaatctgccttactaagtaacaggttagctttttaattccatcttaaaatgcataactgagtgatttagatctataattttaaatagaaatcttaccaagttttatataacattgaaacatttaagattttatgtatgtatacagaatctattattgcttgtcatctatctatctatctatctatctatctatctatctatctatctatctatctacctatctatctacctacctacttacttaccaatctaccaacctacctacctatctaccaacctacctacctatctaccttccttctgagctatttgatttgtcagccaggcaattttaaaggaattgtctttaaaggaaggatttttaaaaattgggccaatgatcaattgaaatcctcttatactattaaaatatgctagactaataatttataaattgattttaaaaacttgagggtaagtcaggttttgaatttgctaatttgacaaatttatattaagctttaaaaccaaagtaaacccatgaatttttttatgcataacagcttctctcaaggacacagaaacactttttattgacagtattgatttgtcttctcccttatgagaatgtgaggagatagaagtcaacacacatagttagttaagagtgagtgcttcctgccccaaatgttcccagtctttcagcacagttgcttctcttagcagtggaaggtggccatcttcaatatcagtaaccatcctgacctttctgagaccaaaggccaagtagcgatggaccaacctgagaaattgctctcatgtattcatgccaagtttccactcctttattgttttatatgacacaggtaatatacatttcttatagaacatttagaaaacaaacatagccaacaagaagatgatattcacttgtatctcgtaacccagataaattaaccactaccaatgttccgtgatgctcctctgtaattgcaattgcgtacagatgtgtttagtttgaaatataatgagttttagttaacaggtatccctgataatgttgcacactctcactcacacagtcatgcttttttttttctgccttgtattataattatggttttctaccttgcttttaccacttagtaacatgttatgaattcctgttattagtaaaataaaaataagaactaaaagtactttaaaatatatttaaagacaatgtaaaagtgtataaaaatcattaaaaagagctgagcccagggcctcatgcctgtaatccagcacttaaggaggccaaggcaagtggattgcctgagcccaggagttcgagaccagcctgggcaatatggcaaaacctcatctctacaaaagtccaaaaaaaaaaaaaaattatcaaggtgtggtgctgcacacctgtagtcccagctactcgagaggctgaggtggaaggatcacctgagtccagggagattaaagtttcagtaagctgtgattgcttcactgcactctagcctgggcagcagggcgagaccctgtctcacatttaaaaaaaaaaaagcataaaaaagtattaaagcgtaaacaataaagcaatagctttatgtttaatggctgcataaattccaatgtacaaatgcactttgttaaataaccttccaatcttcagcattttaaattgcctacttttttgttaaaataagcaacagtctatgaacatctttgaatcttagctaattcattttacaatttaagtaatttcagatgtaaaatatgtggcaaaatgattatgtattttgtaagagtttgacaaatattttcaagttatcctacagaaagatgaaccagtttatgcccaggagttgcttcttagttaaaaccttgataggataaactgagaaacccaccaaaattagaatgcccatctcagaattaaaaaaaaaaaacattaaaaaacagactaaatagatactagttttgttatcagaaacagttgagtttaaggtgtgaggtgctcttatgttaattctctgaccaaacctagcaaagatcctgccattacatcaaagtgttgcactggggttgtcagaaataccaactgtatggctgttggtttgcagccaataaacaagcaaaaaagctcaacatcactgatctttagagaaaattaaaaccacaatgagatacaatttcacaccagtcagaatgacaattattaaaaagtcaaggaacaacagatggtgcggagagatacgaacacttttacactgttggcgggcatgtaaattagttcagctattgtggaaggccaagaaccataaataccatttgacctagcaatcccattactgtgtatatacccaaaggactataaaacattctattataaaggtacatgcacatatatgtttactgcagcactatttacaatatcaaagatatggaatcaacccagatgcccatcagtgatagattggataaagaaaaggtggtacatatacacctggagtactatgcagctataaaaaagaatgaaatcatgtcatttacaggggcataaatggaattggaagccattatcctcagcaaactaacacaggaacagaaaaccaaatgccgtatgctctcattcataagtaggagctgaacaatgagaacatatagacataggaaggggaataacacacactagggcctgtgagacaggggagggagagcatcagaagaaaatagctaatgtatgctgggcttaatacttaggtgatgagttgataggtgcagcaaaccaccatggtacacatttatctctgtaacaaacctgcacaccctgcacatgtaccccagaactttaaaaaaaattgagaactttttgatgatcatataccatgtaatatcttttgtcgataaattctcatatacactggaaatctccgcttcttgttacagtagcctctaccagagtaattaaaatcatgtaggagtggtacaacctttcttaacacagccaatatagatttcatggtataatagttgagtacttaggcaccagccaataatccatccctatgaatccaaggaagattgtccttcatccattccaaagaaattgacctttatccagtccaaaagtcatttaattttgtctttaatatttctggtaatatagtgtccattacccatgtgaaaaattagtgtgcacttaacatccattacgatggctactatcaaaaaaacagaaaataacaactgttgacaagaatgtggaaacattggaatgcttgtacactgttgatgggattgtaaaatggtgcaaccaccatggaaaactgtatggaggttcctcaaagcacaaaaatagatttaccagatgagtcaacaatcccacttctaggtatgtagccaaaagaatcaaaagtagggtctccaagagatatttgcccacccatgtttataccagcactattcacaatagctaagaagtggaagcaacacaactggacactgatgaatgaattgatttaaaaatgtggtgtgtgtatgtatatatatgtacatgtgtatgtacgtatatatacatatacacaatattattcagccttaaaaaggaaggaaatcctgtcacacactacaacacgaatgaacctggaagacatgccaagtgaaataagccagtcacacacacacacaaccaaatactgtttgagtccacatatatgaggtatctaaattagtcaaattcctagaaacagaaagtagaatggtggttactagggaccaaggagaggggaaaatggggagttgtttaatggatataacatttctattttgcaaaaaaaaaaaagttctggagatgtgaatgtacctcacactattgaactgtaaacttaaaaataattaaaatggtaaattttatgttaggtggtttttaccacaattaaaaaatggtgaattacatgtaatgtcaattatattttaattttaaaattaaaaaatagtttcccataaatcttatatagagttttaaaaacatgtttaattctctcacgcctataataccagcactttgggatgcttaggcggttggatcatgaggtcatgagatcgagaccatcctggttaacacggtgaaaccctgtctctactaaaaatacaaaaaattagccaggcgtggtggcgggcgcatgtagtcccagctactccggaggctgaggcaggagaatggcgaacctgggaggcggagcttgcagtgagccgagatcacgccacagcactccagcctgggccaaagagcgagactccatctaaaaaaaaaaaaaaagaaaagaaaaaaatgtttaattctctgtgtgcggtttgctaaatatttttaagtgttattatattttcttatgtagactaaggtttcttactgtagttgtttttacatggcatcaatttcttcatgtttttgatataaactcttttctcgctactaatatatgagatccatattattctgttgaaattcaacataacaaaatgtatcttggataaagtctagacataggaaagaagtttattgtgttaaatactagaaacttaggacaatttttcaagtcatacccgtcctttttgaaatgtaatttggaaatattcttaagatccacataaacttatatattttcttatctacagggtattttatccattaaagatgctacattagttatatagttgttatacacttaactactctaagacccttagcaacagtccatgcataattgcttggagttttaaatgctaaagaaaaatggtgaatttgcactcactaggttttgtagtgaattcttgacatgcatagccaatgcaccatcaggctaaatagtactcatgaagaaacagagataagacacttctggaagtgtgaaaattctgatttgagagaaatgtatgcagaattgatatttatagtacttattttctggctctaatatgttatatattctgctcttggatattggctaattatcatgtcagtaaatgctgtatctggaaaacattttgtcaagtgaataagacttttcatatttctggtaaaagaacagtatatatacttttatacatgtttccaaagatcaaacagctttaaaaaggtgtacatctggctattatttaaccagactgaataatgcatgaaagaatgtagactctttggaataatgtgttattttaattcttacatgactctgttacagagcaagtttatttccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttcattgaaaagaccatggatttcatgtaaagacaatttggggtttaaatttggcctctatattttattataattggaacattaagctatgaatgaaatcttagacaattttctaatttaaaaaatgggaatagatgccaatgcctacctaaagttgttgtgtagagcaaaatttgataatattaagtgtctaatgtaaactctgacatccaataaaagtttcttccttctccttcatttcctacagaaagatttgaattttttacttttgtttccccttacttttctttcatcttgaaaaaacacaaacaaacatgtcaagtttataactgaagacagataagaaaaattttgaatagtaccctgtttataatcctgagcttttagtggaattatttctgaggattaatcttgtcctgcaaatttcttggtttaaaaataatatatatattcttatatatacatatatgtgtgtgtgtgtgtatatattcttacatatatgtatatatgtgttcatacatatatgtattatgtatattctcacatatatgtatgtatggcatagataaattacaataaaagaatattctaaatgttatatataataaaatatataaaatatatatttttatatattctctatatataacattttaaaagttattttattatttaattgtaatctcttatctatgctatccatatgattctgtagaaactcagtataacaaaatataacttggacaaaagctaggcatagaatacaatttattgtgtttaataccagaaacccagtacagtttttcaagtcaagttttttccatattagaataccagttaaaattagtgtgaggctgtgttattattaggatatgtatataactatatgttaggtatgttattagaatatattatatatattattattatgatatataatgtcccttgtatgtaaccaatctcacattgttgctgttccttcccccttgtgggcacctttccccacttggtcatgctctgatatcccatgcaaggtagctcctccttcccaatgtcctccttcaccttctcaggctctgacacctttctgacactttcactgtgtagttccacccactggataacactttctcagcctgcttaggttcccacacaccgcactcggctttcctcttttgcatatgtgtacctccctgctcttttggggctctgtcttcccatgccaagctgccttcctctcccactgcatggtcaccatttttaacctgctcatgctctgtcagcacactctaggacacccattcacatagccctctttacctttgtcaagctccagaatcccattttggtcattctttctcaaaatgtggacactttccacccttcttggtttctgtcaccccgtaccaggcctcttgctgttgaatgctcttgctatcctactccgactctaaatatttcacaccaggcaattcctccctcttttggcaggatatcctccgcacccaacttcaaatttaacacccctcattgagctttcctcttgcatgaatgtcctcatcaccctgctcagactccgttaccccatgccaagctgcactcacatgcagattcccttcctattacactgggttccaaatcccctttgctgtgccttcttcctgtgtggatgcttcattcaccttgcttagacctaaaaccataaaagctgcagaagaaaacctaggcaataccattcaggatataggcatgggcagggacttcgtgtctaaaacaccaaaagcaatggcaacaaaagtcaaaattgacaaatgggatctaattaaactaaagagcttctgcacagcaaaagaaactaccatcagagtgaacaggcaacctacagaatgggagaacatttttgcaatctactcatctgacaaaaggctaatatccagaatctacgatgaactcaaacaaatttacaagaaaaaaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatgctgttggtgggactgtaaactagttcaaccattgtggaagtcagtgtggtgatttctcagggatctagaactagaaataccatttgacccagcaatgccattactgggtatatacccaaaggattataaatcatgctgctataagacacatgcacaggtatgtttattgtggcactattgacaatagcaaagacttggaaccaacccaaatgtccaaccattatagactggattaagaaaatgtggcacatatacaccatggaatactatgcagccataaaaaatgatgagttcatgtcctttgtagggacatggatgaagctggaaaccatcattctcagcaaactatctcaaggacagaaaaccaagtaccgcatgttctcattcatagtgagaactgaacaatgagaacacatggacacaagaaggggaacatcacacagtggggcctgttgtgggatggggggatgggggagggatagcattgggagatatacttaatgtaaataatgagttaatgggtgcagcacaccaacatggcacatgtatacatatgtaacaaacctgcaccttgtgcacatgtacgctagaacttaaagtataataaaaaaattaaaaaaaaattccaccatcccttaaaaggctgctctctccataggcagttagcgctaccaacctaatggctctatggtggaattgtccatgaagggaaaggaaagaaagggagaggatacagaaaagattattagtgacttgctctctattttaaatatttaattgcatttataaaagtaaatattttattctagaatagcttcaggtttgcagaaggcttgcaaaggttgttcagggagttctggtataccctgcacccagtatacctaagatcttccattggtgtgatatattcatcacaactaataaaccaatattatggtacattttgtatcaacatccataattgactatgatttccagtaacatttttaaagaggagaaaaggatttcatctgtttttttgcatttatcctgtatcttacaatttccccccctgaactgaactgttattccaatagaggaacactgaaattactggtgtgataggaattccctaggatattgtcctcctctttatagatttttgtggggagttgctattgtaacctataatctgcagcccagcattccttttttactggacagataattttgtgagatgaggcctgtaaagtgcttggcattgtgctcaggccactttatttctcaggcactggagcagagtgctaggggactataggtttttcagtgactgtaaaagaaaaagtttgagatgaggaaaagaaattgtccctggaacctatttttaaaacagcaaaatctataataaatgaataaatgttttattaaatgtccatgaagcataacattatatcaacttcatgagctattaaacttattagtcacaaaaatgtcattatacttgaaaaaatatctgtaggttagattttcttcaccaaaaatctcgagttggcataaagtcattgctgataaattagggattatcctaattaaataaataacatatagccaaaaattttggaagcaaaggggataataattatgtccatttttttcttagaaaaatatatattaatgaaagatagtcaattttaatataccgttatgatgcacatgaaagtaataaaaatgtcccacctacaatgtagtgagtgatcagcaaattttacttctctttctttcttctataaacaaatattttgtatcatggggaattataagataataatgtagaaaatgcatgcattggcaaattccaacaggagatttgattatttgagttcattttgaggggattccatagcataggatataggaaaaataaacttagacttgtagtcagaagccctgggtgactttctcctctgccacttagttactcattaatgttagaaggctgtgtgttgcctcagagctttgatatcattatctgtatagtgggaatgctaatcatatctgtgtatcaacactaaagtactgctcatgaaatcactcaatgaactgtcaggtctatcacaatattagatgaaattgctggtcattattcttgttgttgtactactatgtcctttctttagaagtatgtcagaaccagtgaggttgatataattagaacattttaggctcctcatacagctttcaatgtcaattttcagaaaaatacagattatttaaataaacagcagcaggagatagtagcgtgattgactgtattttcttcactgcccattgtgataccctgtgaaagtatatccacattttcttttttttgttttgttttgttttttgagacaaagtctctttccgtcacccaggctggaatgcagtggcgcgatcgtggctcactgtaacctccacctcccaggttcaagcaattctcctgcctcagcctcttgagtagctaggaccactggtgcatgcctccacacctggctattttttttttcttgtatttttagtagagacgaggtttcaccatgttggtgaggctggcctcgaactcctgacttcaagtgatcagcctgcctcagcctcccaaagtgctggaattacaggtgtgagccaccgtgcctggccagtatgtccacattttctatgtctccttgatttattgatggttccaatgaagagggggttacctgaggcattttggggcagacacctcatgatagatcccaccaacttctttctgcctgctctcttggaagatatatacccatcttgaatgtttcctgcttactgacttgtcctagggacacaaaagtgctaagtgtatacacttttatcataagttttaaaaatccacaaataaaattaaaaaactattaaaaaatttccccttcaataattatatgaagaacatgaattgctaggtagaaagtcattataaaaatacatatacatttaacagtttcattgttttccaaaaaatttagcgcaattattctgaaaattaaaagaaattatgattccactgcttgaaatcctggcatttattgaagattcctcaaaagaactgacccatttgtattggcagggtcataaaactgctcagagttttgctcaggaagcatagtttgtcctgtgaagcttcttaagggtaacttttcaacacattataaatattttaaatcaattggttgaacttaatgtcatttaagttgtaatgaaagctctactcaaatgctgtgccctgaaaggacaagataataaataaagatatatatttttgccacttattttttagcaagtcctgctgaaatgggagaatgttttaaattacaaagcaatttaagaattctaaggagggcatatagattcataacttgttgcatcttttgtaggatacagccagcctgtacttcatgatacaaaacattctacaaaaatatgtttgagaagtcaaatgtctaaaaaaatacaatagacttttttatggtatgggtataatatttcacttttgggaagctatcaatgagtaccatttcttaagcatcatccctgctggcagtgcctttgcctcctagggttcaggtgttccagtgagtgggttcagaccttcacaggcagcaggagaggcaattgcctgcccattatctcctgggaaaaagagaagtcaagccatgagcctccctttctcataggaacgttgtctctgtctgatcctttccatggggacttgatctgaattctgggtggcttgcagttgttaagtcacttgaagtagatgcctgtaatgttctggagcatggtgaagggaaaagtgagtgggatatgccaggcttatgtatgtggctgcctgtgggaaactctctagctgtcttctaaagcagcactgcaagttgccttttcttattgctgttctcactgcctgcaattgaatgaggactgaggaggagggaaggatttggaaagaaagagaataagttgggtaagggggtgctggcagtgacggtgacaatgtgtgaactgataggtgtctgagagtcctaggaatctgcatgggacccctcagcattgaagagagaagggaggggagaaaagactgtgaatatgctgcagtgagaattgtcagaaagcagtttgttttttggcttggctggtgctgctacaattaatagcctaaaagtgtcacagctacctcatgagggctgacttttcttcccttgctcaaacctccatgggtatctctaaatcattgtcagtcaattctggaataaaattgtgaatttggcctacagaaggtggtttagggcatgacttaaaatatacaaacatatctattatgtaaatgtcaagaatcaccttttccatgtgagtgtattgaaaaaactgttatacaccataattccctggtcacaatagctcctgaacaagtcaaatctatatcaagtccaagtctagcgagcattgctaagtgctcacattaattccaaagtacagtttgtatttacttaaatcctactttaaataaaagaattaaatgaccagatagatatgatgaatctatatgtgactttactcgatattttcagttgtttttctgtgtgttgccaataattacaaatggtgttcataaaatcccaatatttccaatacggatatactttaaattttaaaatgtatttcttgtatatgcagtaccatggaaaggaggagaatataatattgaatatagtatatttaaacaatatcctttggccacgtgcaaggttattgtaaacttgcagaaattatagaattaaaaccttataaccatctctcacaggtacttctgaaggagaaataccaaagtcaaacattcttttagaaaaatattggcttcttttctttcaaaataccatttctaactaattataaaatcaaaggaaaccactatagttttaaaagtatctgttttggctagttgaggaaagtcagttattattcagctcacgtaacatagttcatcttatatatgtagcatttttattactgttctagtactgattttagttcattgcaatttatgctatttgcgctctatttgaaacacttttttacttcatatagaagcaaaaagtatgaggaatgctggagcaccattggcttttggaaccattctattctgttattgtaatgaaattattaatttaaggtggaaatccaaaatgttctgtatggtatggtgctagtacaaacggtcattgactcctgtacaaattaagctgcaacactgtttagaaagattgtgggactgtaagaccaactaattatacttatccattttctttttatcacagtgattttcttatcagagttcttaaggcaatgcaactatataggaaagatcttttactagtgctagttgaaacttctgaaatagccttggttgtatgaagaatttttttaagtgagaaccaaagccagatttatttttatgggaactaaaaacatggatactcaacctcgattaacctcatgatagtttaaatacaactaatcttggtttcttgtttatcgagtcattttctctacttaaagtttattaatattattgtcattactgtttatagttatcgctaaatacagcccacaggccagttggtgctgaaagggaagaccttttatcctataatgtttaattacttctttcagcttgggaaagtatgggcagaaagatagtgaactttagcataagaacaattgaacaaagttctatttagtctgatggttttcctcaattgtaaaattgattctcttgatcaatagtgtagagagaaaaaaaggtaatgctgcagagaagtgaggtggaaaatggtaccattcaataggacttgacagcagcaccacaatcttgtagtggcatagattccaagaatagctctgttcatggccactagtaaatacaaataaaataagcaaacacaatttaaattattttccactttgatttagtcacatcatttgttttgtccattattttgacagagtcctctaatgaagcatttacttggtacaaagaattgtgtaagggatggcagatatattgttagaattttctatgtaagtctagttataaaaatgcaataaataggccggacacagttgctcatgcctgtaatgtcagcactttgggaggctgaggcgggtgtaccacaaggtaaggagttcaagaccagcctggccaatatggtgaaaccccatctctacaaaaaaatacaaaaattagcctggcgtagtggcagatgcctgtaatcccagctacttgagaggctgaggcaggagaattgcttaaacctgggaggcagaggttgcaatgagccaagatcgcatcactgcacagcctaggcgacagggtgagactgtctaaaaaacaaaacaaaacaaaacaaaaaaccaatacatatataaatatacaaatacattcagtgaagtcatagtgcatatatacagtagtgagtgaaatactcaaaacacaaaatactcagtgatctccatgatgcctcttgcacaggtataaacagcctggacagtaatttttcctgagaatgcaagaatatgaacttagatgtacttgagattcagatgtattatactgacaaaggtgtttgacaaattatctcctgactgatgccacaattcaagatgggataaaggattttctaatagataaaggtcaccaggagaattttaggggtctgacagggggtgccaggctcagaatcagggcatagatggtgggaaggaaggcggcaggtacgagatttcagtggggaatggcagtggtttccagtgcagtgagctgagtacaattgggtaccacccttctcagtccccaggtaccatgagcatgtggcaaattgtaaatcactagttggacaaggacagcttctactattgggatctatggatgtgctcactgatggctggacactagaaaaggaaggtgtttgcttactggcttgagagaacaatgagaagaagaggaagaaaatgtcagtaaaaaagaaaagcactgatggaagcataagacctgaagaggctacagaatgcaggaggtcctatggtggccaccccagaaagaatgagcagcagcctgaatgctcagagagaaaggaaaatgggacagctgcagatggcaactcacagattgcagcctagatgctcgctggcctgctactctatccctgacttcacatgtacaatagcctgtgtcctctggtctccatggtgcagagaggtcaaagtacactggtctggtttagccttctctacaatcccaatttttctgagagcattagaaaagacaaaagaaatgggagtgctaagcatttggtatatgagggtgatatggtttgcctttgtttccccacccatatctcatcttgaattgtaatcccataatcccacatgttgtggaagggacccagagggaagtaattgcatcatgggggcggttagcctcatgctgttcttgtgttcttgtgttgttgatggttacataagaggcatttcccccacttcctccacatttctccttgctgcctccatgtgaagaaggacatgcttcctgttccttccaccatgattgtaagtttcctgagacctccccagccatgcagaactttaagtcaattaaacctctttcttttgtgagttatccagtctcaggtatttcttcatagcactgtgagaacagactgatacgtggggctactaaatcaacatatgtacaaactttaccttatctagcaccttcaaatcaatgttgtttaaacaccacttcttgacctgttcctggccctttcatctatttcttcactatctcccataagcttgatggtgaataaagctcattttgtgttatcattgactttctggctctgtccttgatttcaaacattgcatctgatgcattccagatcgtggaaccctatcccagaattaaagttaagtttgtcttagcctttataagtgtggagtaggcagacaaaataatacgatcaaagacttacaatcagtagtaatgatcaaacaggtctatgaaggaagtttagaataaatagctaatgggttataaaagttctgaatggagaaggcaatcttaatcatgtatagctatatcactgaggggaaatccaaatgatcctggctttgaaaacggccttagaaacttctaagcctaaacaaagtcaatgacatattagagattttctggtacatttatgtcctcatctggttctgtattcaaaggcagcaccatttcaaaaaattggatggaagcgtggattggggagtgcagaaggagctgagtgggatcctgtgagagatgataatagtgcataagtgcatatctcattttccagaatcacattgctcaaaatatcagctactttatcagcaaagctagaggtcctggcagtggtggtggtaactccacagcttatgtgctatggactctctctcaataatctccaaaaatcgactaacaatgagaattttactagaaaaagaaatgactttaatttacagagtccaaagaccataggtcactagtctctgagcatctagtatatggagaaccagacataccaatcagacactctgagaccccagcagcactctcagattgcagcctgcatgctccccagcctgctactctgtccctgacttcacatgtacagtttcccacagatacctgtgtcctctgtctccacagtagagagaggtcaaagtaatataacagaatccagaaggcctggccttcagcatcactgtgtccctggctaatacaaaggccatgtcacttttccttgctggtcctcatttttctcactttttataaaagagattgagtctggatgactcctcacatctttcccagcactttgaatttttaaattcataaatcatttgagaaaattttgctcagttccatctgtacctgtatgatgatgctgctcacttaaactcttcctctgtctcatccaatatccaccaagtgccgtgtgactcagtttcctctttgtatcagtgctggcttgggtgattcctgcctcctctaagatggtgaaatatagaacaaatagttcctattttatttgtacatttcctttttgtgaagtcagttttgactgcaaaaccagcaaatcttctgtgaataactccttttgctttataataaaataggaagatttctgataacacaggtgattcaagattgctgaaaggtttaatgatatatgcacttgaagtgataaacgaattatgttgaaaaagaaaatacttagaagtgaatgatacagaattgtctgaaaaacattgtaatctcagccatcatgaataaattcaataattttactacttctaaaaaatgttctacaactgatgttatgtatttgattagagaaaatattccacaacatttcaaaaccttttaactcacataatatatcctactcataacaaattttagttttgaaaactgcttctaaacaagtcacttaacctccctgcaactacttttcctcatctgtaaactgcagagtttgaaatagctaatctctaaagtgccttccggtttgaaaatgttatgattcagttttgcttctcatttattgtatacagtgagaacaactattttagtggctaggcacaatcgaaaacctaatgataatgacttcagcaggggtctaattggagcttttagatataaattcaatttatgctaaggtctttctcatgggccttagttggatggcggctttacagaatattattggggttgggtgaattccaaagcatctttattttatagcagtatttttacttttcaatagagtcatactaatttataagttcatagtgtagaaagactttggcaatgggaattatttttaaatgaaaaatgatgaatatattttgcataggttacataatttcagagccagaagcgatcctggaaaatttatgcagtattaccaggataagaacaatgctaaaataaggaaatacatgtacctgattcattaatcagaagatttatatggataattttctaacagaaaggaatattttgggattaaataataaaagtgaatatgtttccaagataaaacagttgtccccattattcctaccagatgtcatgtggagaaataagcagcaaaacagaaaataattttgaaaattgtgtagataaatatttttcagattatattttgtgaccattatgtctgcaaaaacctattgctcaaaaatgggcactgtattcaaataaatttgggaaacactattttaaacaaagttaaatcatattttaattatagaacttttagaagccttaatattttagtgtgatatttactgttaatttccaagaggatacagtatacacagttttaaaaataaactcattaactagggaactttaaaaatttttgatacagattaaaatatatataataattataaagaaagagtactataaaattttaaattctgatctatgctatcttggaaaacattcagcttaaaatatttgtagttgcagttacttgtgcaactatatatgtgtctttgtatttacatatatgtgtttttttttttaactaaaagacaacttgggaacatattcagaaaaacttttatgttaatgttcgtttttatgctgctatttgtcttcatggtgttccagtctgggttccggggttatgtctttagtttttgccactcatttgggctctaggtgcacttttaacagtttacttttatctgtactttactatcttacttcactctcataacctcaaactgaatttggctcaacctaatttatttatccattgcccacctcgttttccctccactctgaaaaccacataaaggcgttctctgtgcagcatgccgtatttccattagtagtgctgcaacacaccctgccagaagcgtaggaccattctgaactcctttctttctccactgattactgccaaatagttaataagtcttgttgattttacctgctaatagatagctacctgaaaaagaatgaaactggagccttttctagtatcagatacaaaaatcttctttttttctatctctgctgcatgattgtaattgcctcctaattattcatcacatatacttttccaagctcttttttctttttgtcacaatgcatatttaaaacacaaatgtgatcataccttttcttcccttcatagcctctcatagcttcttcctttgtagaaaatgccaaagtccttactatggcctacaaggtcgtcagtgacatttgcactctaatgctttctgatgccatatcccctttctattttttaaaaattaactttatagaggtgtaattaatatgcaataaatgcaaccattttaagtgcacattttgcaattttgacaaatttataactttatatatttagggtataggacatttctatcacaccagaaatgtcccttgggctccttctcagtcaacttcaaactctaccccaggcctttctggtttctatgattcagtgtatttttttttccttcagtttaagtggaagagtccttgacatgttcatgcaatgcagggtcttccctagtgttgtttcctctgcctgggatcctcctctctgcctctaatgccaaacacatacccaattgcccaccaactcttatccatccattttcaatttaaacatcatttcctgagtcatttggaagagtgcctggccacatataaagcactcaagaaatgttagttattataatgaattataaattggtagcttgaaacctattgggttttcctgcaataaaattatagaaaaatggataacagtttaaaataaaaatactaatttgcatctattgagatgatcatatgatttacaaagtgagacagttttgatgagggtatattgttcattctgacatttgctttgaaaccagaagagctctctgtgtttttctttagtctgttattggtcaatacattttcttagatgccatcaaaggtagaatttagagaaaaaacccattagatcaccttacagataatatcttctgtagttgtagggtgccttaactctgtgttcttaatgcacaaaaaaaggtctatgtttacccagctactgaactgttatgtggaagagaaagagaaagaaaaggaagtaattactttgttggggcttatcccatccattatcctttgtctattattacatatctattgttttgatactttttgctatttttaagacaagatctctctctgtcacccaggctggggtgcactggtgccatcatagctcactgtagccttgaactcctgtgctcaaactcctgggctcctcccacctcaacctcccaagtagctgggactacaggtgtgtgtccctgcacctgaacatttttaatttttttaaatgatctattatgtcattgtgaaggctacattgaccaggccatagttctggattaattctcccaaagccacatagatgtgagcttgctctctaattaaatatcaagaattattttaggaaatcttcttggtgggatatcccttctggtgattaataaatcataaagctcaaagaagacagttgaaggagcagctattaaaccaatgtgatcctattaaagggaaactgagaaaaatcgttttagccagaatttgacattaaactttgtaaataaattaaaaattttaaaataatttttttctaaggaaattgaagaaagtctcatataataaagctggatactcttccacaattaaagataaaaaagagaagaagttggaagtgtgttatgttagtgactgatgtgatttgtatttatgtgctctccaaagaccttgtgtagcctggaaacattcatttgttaaaatgctaaaaagtaaaatatttattgtttcatataaaatcctctatgagatgaaaataaaggaagattatttgctttaatcataaattgtgctataatattttactctgaatatttgtgattgtactgtttgtaatagtatcatcagttatgttgattttagtcctctttatttaccttgaatcaaaatttttcacatctcaaatacatttctaaaccatttatttcagttgtttgaagaaagctagttaagctgctattttatcccttggtttatgattttacaatttcttgtgtttctactgacgttttgccatggtgtggccctggcaggatttgtttagggagtgtgctcaaatgagaataagagggaaagagaaaataatgcaaatgctgctgaaggctttcatacaaaccaaatcatactcaattactaaaaagaattagactggggcttgtgttgccaaaaggcatttaagaactcaaattatgtaattaaaatgtttatgttgatcaaattagccagagtacaaagcagtccataacaaaaatgaagttattcaagttaattcaaaagttattaacatgtacaagttagaaatttagcaaaaaaaagaaatatccacctgctacacatatatagacaaatacaaatcactttaaaactcaccacataaagataatttttcattctatttcttttgaaacccgtgtttttcaacatattgggctcctatattcatgcatttttataaccttctttttatactcaaaatgttaacacacccttacatctttttttaaacttttattttgaaataattttagactcatataaaatttgtaaaaatagtatgttttcagtgtacccagcttcttccaatgataacattttacataaccagaatacagtgatcagaaataggaaactgacattggtgaaacattattggtctacactatagcccttatttagatttcaccagtttttatgtatgccccttttgtgtgggtgcatatgtgtgtgtatttctttgaaattttatcttcaatgtagctttaatttgcatttcttttatggtgaatgagttaaatatcttttcataagtttaattacaatttttatatcttttatgtgaattatttgttcatgtatttgcccacttttgtatctggttttcatattctttttcttaaattttaacaattctttaagcattaggaatatcagctctttatttgtgatatatgttgcaaatattttagtttgtcagttttatttagattaaaaaatttttttgaaaagataacagttgtgttaaaatatagttcatataccatatatttcacacatctaaagcagacatttgaatgttttccagtatattcagagttgtgcaaccatcaccacaattagttttagaatattattgtcacttctttcctggaaacaaacaaaccttacagtcattagcagtcactatttccttcccaaattttccaactttaggtaaagaccaacctactttctattgctaaggatttgcctattcttgaaatttctccttatatcctaagacttaataggtctaacagacatgatattttgaagagctataatgtattctatggtaaaatgttgccatatttatttaagccatcatgattattaaatattttggttgtttccaaatttaaccttataaacgatgcatttgattaagttatgactacttttctgttcatttcctaaagataaattttgagaaatcaaattgtttggtcaaggactgggcacatttttaaagcttttgtcacgttttgacaaaaacaaacaaaaaaaaaattgaaagatgttttcaatttgaactccctttgagaatggataattcttgaacctttaccaaaaactataattagagattatttaaaaaattatcttatttgaaagatgcttctaactctctgattaacaggaattcaaattttttataatcacatttattagatattcttatgacagactgaccttgctctttgaccatttataattgaaatgatagtttcttactgattcctaagagcttatatatgaaatatattcacaagttttgtcaaatatattgccaatttgtctccatgttgccttttaaaattttgtttctgctctttttgttctatagatgtgaaaacatttttataaatatattaatcttttgtgttttaatcttgaaaattacacatattatgtatacacctgaaggaaagcctttttctaattcctttatttttattttatccattagtatatgtggaactttttgacttgtataaatattagggggagctctgtgtttccctaattaaacaattgtggcatatgcattctgtagaagccaatggtgatgcatttccacaggaactattcctgctcaaaaaaaaaaatcagtgaaatttgtctaacgtactcttatgccataaatacaaacaattatcataatcatttgcctgtgcttaaagttatttcagtcagcacattactaataatttgctaacttagaatatcaaacattaatcattatattttgtataccttaaaacacatactgaatgtttttaaagatgcagacaaccagcacaccttcccacccaagctaatttcagtgtaatttaaaattgatttgaatctgtatatggaagatgcgcatggcttgttcttaagttttgtggagaaatcagagaattttagacctgcacaacacagtctccttctgtacctgagataaaagcgggagctattttttgtttgtttgtttttcctttctgctctgggtttataattagaatacaaatagtcttggtcctgcaaaaaaaaaaatctagggaagaattattgatataaaatagatttgatttttttatggcatttcctgaatcagaatcaaattgtttggccgaagatgtgtttggttccatcttaactgttgctgacttcagtcattgctgtttgaaatttcccttaggccgaacctagcctatagctcactgcttgcactatcatcctgtggggaagcaaaacaaaacaatactggcacagaaatcaaccttctcccataataatgtccttaggaacaggcctgatagccacattgaaaaaagcatagttgcaccatatctgatgtagccatttcttgcactatgaactctgaggaatttaggctggaccatcgatttgaaaatacatcagtgtcagtgcagtgaggccagggcagtttgaatggtcgtcttcatgctaaaatctgattgtttttattgaatgcttttattttttaacctgttgtaaatttatatttgcataatataaatttgcaatttaatattttatatcctctttcaatatttcctttctgctttttttttttgctattctatcttccgcttaaaaaaaagtaagtattgttgacattaatcagtttcaaggatgataggaaaaagaggtttgtttttctaactagttatctcccctttctaacttcagaatatttgaggatgcaatctcacctctgttatttactgtgagaatttgaggaaattacttaacttttctgattctatttttctaatccgtaaaatgggatgaaaactgctgtcttgtaaggcagtagtgagggttaacaggttctttagctcttacaaaaaagtcaagtgattacatgtatctgacatgttgctagggagttacaatattaagatgaagaaggtagaaagtcagggacttggccctcaataaattttaggaccagtaaaagataggaaaatttagagtctgcgagtttgaaagagactggttctagaagagcaattcattatttctgctaataatataatgcaaaaaatcagttgccatcatatttgaatgtttgttttattattaacttaatggagagccttaagtctattgacctcatgtgagaaagccaagcttctcaaataatttgattgcatctctgtgaatttatttcactagggtgaggaaattgagaaccagagacttggggtgattttcttaaggctttagtgacaagatcaaggctaggtccaaatttccagtagatttatgtaacttagtgcatttttatacttatgccaaaattacttattttctttttatcagaaacactattcagaaaatgagatcagatgttttttcaggtagagtacaattaaaaaaagaaaaaacaattacagagaaagctcttatccagaaatggggctagttttcagcatctatttggaatttaaatgcattctagtgaactccaagcagattagcctgtatttgaaatataaggtcaagtgggaggttataatcagaaagaattagaactccagaaattaaagttaccttgagagtaaatggctgttctatatggaattattttttgttaaaacaattttacacaaaatgcctttataggtaactattattttaaccaaatgtaataatatacgaatgacatgaaggaatgtaggctatattgcgaattatttttgaattgtgactgttacagctattataaccaggagtgtagctaaaaacctagtattatgtattaagacaataagctgatcacacatattaattcgtgctttagaattccaatatagtctatacaagaaaaactagtcatctccagttgcttaaaagacaagtaattctaataatcttgtgaatgcagaattgaaaacgcacatgataatggataatggagttaaagtaatagaaagttcttgaagaaacttatgaaccccttctgagatttactttataatgatttatagattatcttgattggcgtgatggtattatgggtttttatatttgtcaaaatttattgaactatacgctcactttgtgtatatattttactatatatatatattatatcccaataaagtagtttgaacaaaacatcaccttaagttgaacgatgctatattgatgtcagatgctctgtttgccaaactatttttcgccattcaatctccttgttctttatactttgatactttggttgctagaaatgtagctcttgggaaaaaataaaaataatacattcttaataaaagtatgatgaaatactcacttgcaaaatgtccagaacaacatatgacagaattttgacatctatgaaaggcaccagccctctttggatttctgcagcattttcttttgtacaaggaaataatgctcatatagaaaagacactactgaactttcagaggtctcctacgaacggaactgtagtactcattgtattttaatcaattggagttttattctatttttatattactttaaaattggagtttacacattggtaatattaacattttttagtggtaataaaattacatgctgcaaggaaatcaggatacagtagcatactgctttaatttttagaagttagtgtgaacccaagatcatgaaatcacttttctatctctgttgctgaaagcttctgaagctggcaatagaagtagctacaccttcacatcaccagtactcctgattgcccccttgtgtcgatatattgaattttaatccccgtcaaaaaaggggaaccaggccttcttagagatctcattctgttgttggaggagagatcattcagaatgagcacagaattttctattattgcaaaaagcaaaaagtgtttttaaatatatcaaacctattcctgaatggacaaagaaccccactgaagaaggctatcactggccaatggataaaaatgtaagcttaaataagcttgaattcaaatgaaaataatttgaatctgtaaaaagccatgagttcaaaatataatttaaaggaaaagttacaataaaatttgcaatggtgtagttatgatgccaagaaagggtaacttcgatagtagatatttgctttttatttattttatcaactatgtagaatgtgtgtgtacaggtattctatatatgcatatacatatatcctttttcagtgtttaagattgtttcatgtatatatagttattaattataagcaaaatgaaagcaaatacctaaaagaaaaagaaaatataaatatttgagctcatataagctctgcatatgcagattgtgtgcatgtatatgtgtttgtgcatctttgtgtagctagtctatgggaaagagtaaagaggattaaatttgagtgagccaaacattctctgtaaaggtaaaaacaatttataaatgacaggatgttgtagcagatattttcttactaaacaatcctggtatatgataaccacttagaaagatactgtatcaaagggacagccaaggtatatacaagggatcaaggtgatcctttgatcacctctggcggtcatacacattaattagttaacaccacgttttgagataataggttagccaggttccaaaaagaagaattgttggggcagacttgaaccttcattttctagtagataaattgccttgattctcattctgttgaagttatagataaattccacagaagttttgaatcacaataagtgactaggtaacaacacaagaataatgaggtagcattgatcatttcaaaagtagagatcacatgttttctggaaaagatgtgaaaggcttggacttaaaagtcccatggggcagcaaatcaaatcactctggactacacaaagaatcacttggtagtcaagcaagaacaacaataacatttacattcagatagagttctatttttaaattaagtaaaattattatcattctaggaagttgctaaacgaagtatctacttcaaatacttaccctttagagggcataatactagaaataataaattataaatatataaaaatgtataaatgcacaaatgagtaaatgaatgttgatcaacattctactgaatacttgagggtctctatgcagatttccagagcatgctatctctctctctctctatgcaattcgctctttcccagtattctgtcctgcaaacacttgccacctggattccaagtctcctcacctttggaagtccatcagccttattcagaggagtgaacagggggccgatgtaggaatcacttcatttatttcctgtctgacaaggaactctgttctttgttggctgatgtccagtgttttgaaaaaccttgattaatagtttttggtttttcttttgtttgtttcagggagggcaaaactattttctgttagttcttctttgccacaagccagaaaggacatatatgtttactattattgtaacaaaataggaagtcctcataaagtttttctgctgcatatcaaaataagatggttgcccccaaaaaagcacttgtccaattgattgagttgagagctaaacaatcccctttcttcatggtacacaatatatttttttttgtaaagagtaactgacagacaaattatggttattcatgcttggctatatggcaaacatttactttaaaatgaaagaagtgatcctgtaacttcaagacaaaataagtgatcaatatttgttgccagtgataaaattgaagctgtcaaatgaaatcgaaattttggaaaacttgtgtgacatccactgtgagttgagagcttcccaatacttagatttttctgataaggatgtggtgatattaacaaataaattttttattgtttaataaaacatgttagtattggaagaactgcataactcagtgaaatcatatttttcagtgatcaatggtagaaaattatgcaaatgtgaaagaccatttaaagagtggaatatacaatttaatataacagtataatgtaacagggcataataatatttattaaatggatttcagattgcacattgtaatgaagctttaataagtcaccaattgtcaagttttagtgtagtatcaagggagaacgttcacagttatctggaaattatattaaaatattcctctttttccaactgcgtatctatgtgagactgaattttcttcaagtacttcaaaataacatattgcaacagattgtactcacaagtatatatgagaatttagctgactttcgatggccatctattaaagagatgtgcaaaaatgtaaaataccaccactaatctccccaagttttttaagaaaatatatttactttctactaaaatgtgttatttatttaaaaatataatacatgtattattgttttaaattaaattaataagtattttaatttttcaactttttcttttatgagaaatactgataaatataactgacttaaaaaaatctttgggattttcaattaatttcagggtattaagggattcacagacaaaaacattttaaaattgcttttttaatcactgtaatatcatatacagataaagccagtattattcaagtatgtatcacatgcctggtccaatcaaagctctgttaaaatacgctcaattcttttgtttgtaaggaaagtacaataagataaatactattatagcctccttatagataatggaaaaatgagacataattttcccaaatcataagctaatgtgaaaaaagtcaaaatttaaacacaggcagactgtctctcaagtttgtattcttaaacaccattttatattattctgctaagtgttttgttacatgttacagtggtttcaatattttagagtagaacacatgggatatccttgttgaagtgtttggaaaattatttgaagtatttatttggaaggggcttgaaagtatttttctataattaaaaagtgtttgcttatttttaaagctcaaaatagatttgttacctatactattaagtagattttaacatactaaatatcttttattacacattttttagtttctcctaatttacagagtacattatagtggtaagagcaggggctcagactttcttgatttgacattttagggccatggtcaaaccctgtaaactctttgtgcctttgtttcttaatcttgaaaactgagagaaatagaatctatcttgtaaagaacttttgtgagttccttgaactaataaatataaaagtctcagaaacctgcccttaacatagtaaggcttccaataaatactaactatacttgttataataactagatagtattaggtggtcacgaatgtaacctccataaataaagtcttttaagtagaatgataacttgcaccctttgatgtataatttcagttactaatacatgtaaccagacctcatacaattacggttaactgtattttccatcttcaatgcctgataactacatagttggcgtaatcacaactctcaatttgttagctttataaaaatagttgagccaaaatgttaacgtatgcttagcttatcctcactccttttccagtaggattgaggccagtttatttttacctgctatttagagttatagaaaaacctgggttcctagcatcttatctctgatcaattcttgtgatggagtcccttacatttggcaccttgagaagctgctaagttgtccacatcttaatattaggtaccaggctaagtgctttatatacctttttatatttagtcagatagcaaacccataaattcgttatgttatctgactaaatataacctaccttaggtataacataaggtatacctcctagtttccttaggaggaatactgctgtccagaaagtagagtaatatgctcaatgttgcacagctattaggtggcaaatctgagatttaaggccaggcgaatcatctcatcctttgaaagctaactactttgactttcttagcttcaagaaattgaaataattagattgaaattgaaataattagatccatctataagcttatttgcaatattagatcctgtgattctgcaacagttgagacaggagtatggagaataacacagtctttggaatcatataaagtgaagattgaatccttaaccagccatgttagcagtttaaccgagagcaggttcttcaccgagagcaggttcttcaactcttgtgcacatcatttcttcatctaaaaacaaaaataggcataataatttatacctcacaggatagtcaggaggactaaatcaaataatctatacatagcacgtggcatataataagcattcaacatataatatctcacctcctattaactgggactatttttagtttggctccttgggtgctagcccttttccattagaagagagtttgcaaagaagctgttctccaggtttctgaaagctctggttcttgtgttagccccttcatggaagatgtcaaagaattttagataatactatagaaaagtacaatacaaattgatatccattgagaaggcacattttaggagaaaaatgttcccactgaccagaacaaagttctggcacagaggcagagttctgcagccttccacagacacaggcatgtttctttgtccctgtccatggcaaagctatgctctgacctcatcatccttcaatcagttgttcatctaaagcatttcctttctaatgatcatcatcatgaaggtaatttgcttgattggcagcttattatttcctattaccgggtcctctgctaatgagtatttcccatctggataaatatgttttaaatggaacttcttttggaagagtaacaatatctagccttgtttatgcaacaattgtctgtaaaataagaatgccatgaattttatttacttcagaatagcaatagataatattaaaagtattattttgagtaatctccttaaaattggggatattagtagttgtgttgaaacctgtcaaactcagtaaacaagattctcaaaatacttaactcaacttcatttgtaggacattaaccattaaaccattttctatcagattaacttttccgggatagttttgaactgagatgagattgaattgaatacattaactaataagcactagattggacatacagaaaaccaataattagtattgtagtatttgtgttttgggaggtaggataaagtgttatgaggtgtgatgaacaagctttcttaatgagtgagaaaacagctcaaagtacacattgatctataaacaaaattgactgactataaaataaaatgacttgagattataatgctttcataagtcccaaatttggaagggttatacatccaaatacttaaaatatactcattgactgctagggaatataatatttaatagcagattattatactgtcctagttaaaataatcacatgggtaaaactagagatattctattacactcaactcttatctatcttctttaacttcacacttagataggaaatgattgttaacattccttgtatagcacataatttggcctgtccaaagaaagatatggcctttgccctaggcttttgggaggttatttacatcacacataataggaatgtcattgtttaggatgaatttggatctggatttacactggatcttagggtgatgccagccacaccccatagtcttagagtgggagctattcatgccagaaagaccaacaatgtgacttagggtgaggacttttggtcacattgtatcagttggtctggagactgagtccaaacaatgggcaatcaatctattaagtaagcccacataataaagccacaataaaaactatggacatagaaacttgggtgagctttcttagtggtaatctgtgcatattgttactcatcaatgctgggaaggtaatatgtcttgactccactgggagaagacaatggaaatttttatttggaaccttcctagactctttgtagctcttcctttggctgatttcagtttgtgtcctttctccgtaataaacagtaaccataagtacaaaagctttcagagagttgtgtaaatccttctagaaaattattcaacctgagggtgatttggggacccctccctcctgagcttttggttggtgtcagaagtaaggacagttgagggctgtgctctcaaacctcacagtttggttaactccagggattcataataaacattataagcgtcactaaaacctgtattgacttctgaattttctcagcctaaattatattcagtagaattttgctgttattttggacatactgtatttctcagaaagaggtaatcaaacactcgtgtaatacagaatttatcagttgcctactaggcatgtctagctaacatgtaagattattttattagtccagatatttcactgattgagatatgtcataatctcagctatgctctgctttctgattggactaaacaatatatactttttcattaaatgattcaatacaaatatttaagtaaaatattcatattctggtctaaatccatctcagtttttatatggggcaaatcaaataaaagtttgtatttttttctgtctgattttccctaaggttgtcttaatgacctgtgaatagcaagactaattattttgttatgtcctcatcaattgtacaaataaattgaaccagccaaataagctggttccatttgattagctcccactcactctgcttcagccattgtcatttgttgggaagtgagattacagaaaccagctctcccatgaagtggaacactgccaactctgttgggagaacataaatcatatcacagttatatctcaaatccattattaataaaactttgcactgtgggcttcagcctgcagcagacatttatgaacaggtcagaaaatgaagagtgtaaatggaaacactgtgcctttaattacagctgcacaaatggcagcactagagctacagaattgttaaaaatcagttaaggaaggttgccacctgatctgcctgcacataatctgtttaattaggtagtgtgtttctgaaatcaaatgtttctggaaactaagacttttcaacagcatgcaattttccttagaagaaatagttcagatatttactgggctctgctgcttcaaacgaactaagaatttaagaaataattgcactcctttgcacaaatggtataacctgacccaagcttgttaaagaaactcacctggtaccctcttaaaatgtaatataacttttttaagattcattctcaaatcatttgggcattttataatttttattttagttgttcactaatagaaataatattcatgattctgcaatacagaaaatacatctctaattgaaatatgttcataataatttctataatccttaaattataggaaaaaaattagaatttattttctgctttttaataaataatttgacacatgcaatgaagtttgctgtgattcttcagtagaaggactgttagaaacaaaagctgaggaatgctttgtagtagaaagtatcttttggaaaatactctagtaagggaacatttgaaattgtattattggtgtttgtggtacccctatttacaacagttccatcattcactcagttattgttgaattctagcactatttacttattagctcatttattcctcatgtaattatgaggaatttattaatattctcattttatacatgaagaaattgaaactcaaatgattgtggtaacttaagtaagtagatctatgggcatcaaaataaaacattcattaatttcctgagaattttttttatgatgtcactataaataattcttaaagagtagaataaataattaaattaataacaaaggctgggcgcggtagctcacgcctgtaatcccagcacttggggaggctgagatgggcagatcacaaggtcaggagatcgagcccatcctggctaacacggtcaaaccccgtctctactaaaaatacaaaaaattagctgggcatggtggcaggtgcctgtagtcccagctgttcgggaggctgaggcaggagaatcacttgaacctgggaggtggaggttgcagtgagccaagattgcactactgtactccagcctggctgacagagcgagactctgtctcaaaagaaaaaaaataataaataataaaataacaaatgaagacaatgtcaaacttattgtatcttacttctaaatcacaatggcaattgtaatattttaagctaatttaaaaacattttatgcaaaaagatccctattgatgccgttcatcgatctagaaaaaaataaactcttttaacaatacctggtaaacttctaattgtttataaagattaaaaaattgtttataaagattaaaaaatcttgttttttaatatgaaaatgttaaaacacatggaaaacatatagatcctaacatgactcccataaacccattatgtagagttaacaaatgttaatattttgcaaatttgtttctataacctttttgctaaattattttaacataaattacagatatgatacctcaaacttaaatactttttatcaacttaacatttctcccattataatgccaaagagtatcattactatacccaaaaatgttaactaaatttccttaatattgtctaatatcttttgcatttttcagtttcactaattaaccatgaatgtcttttaaagttaatttgtttaaaccaagatccaattaatgaggcattatttttagttggtatgtttctctggtctctttagcttctgcatcacccccaaccttcttttttgtgacattgactagttgaagagaaagttccacctatttgtctaattccttctttggcctcatagtatcatccaatctgtttctctactccctgtattattgataaacaagaagttagatttagcagcttggttaaattcatattatagtattttggaaatgattcttcataagtgattctgtaaacctactgcatttcatctgatggatacaatgtccaattgtcccattattacttttactaagagtgatctgggaattcaggtggctgcagcatgattccttcatggtagatttgtggttttcccttccccgtctgaatcttgctgtgaaaaatgcaattggaggctgtatatttttaattttctgtttcatgccaatctctgtaataccagtaccatattcttatatttcccctggtttaacacataattttgagatttataataggatatatggggagttaaataatccttaattgttgcagaccattttgtctcttgaataaacatctttaaaatgtgaaactgctcttaatatttgtggatctgcgagctggaagttctctcattaaagcaaaaccatcatagaaatccttttctgtaggtttatttttaaaagaacttagtttcctccttctttccaatcccatgaagatcaggatttgcttctggaaaacttacaaagggagacattgatgctttaataaggcaaggggtggttcaatggaaaagcatgtagcaatagctcttgccttagccagatcagttctgttttaatctattacgtgttgaacttctgattctgtgtaacatttggtttaaaaggtagaaaggtataaacagaataataaaagcacacacatatgcgcatgtgtgcgcacgcgcgcgcgcacgcgcgcgcacacacacacacacacacaataacaacacacagtatacaaaatatgccacctcttgtccacctggatcttagtacatggtgtaggagcctgagaatcacctagatggcattgccactggagaagaatctggaaatcctgaccctagctcctcttcagatgagggacaatgggtaaccatgtatgctttgctagtgtaacccacaggcatggtgcataaaatgtttctgttatttttcaaatggaactggctatttcaagctgctgacttttgctcagggtttttttttttctcttgctactgttcttccttgtttttctgccaagaaaaattttcttttttctttatgagacaggatctcacttcctttgagaaaatcttaattatccttcaaaagcagaatacaagtcacctcatctctaaaatcttccctgagcctctcttctgtcttatcacaagaactttccagtttgcaactgattgctggtataattgttttcctccctaaagtgagaggccctcaaagttgggtggcatgtccttttcatccctgttagtcagttcttaggttataataagcaataaatatttgtttaatggataaaaaatattgtaagccttctgtaaaactggaaaagaggaaaaaaaggaaagaaaaggggagaaagagagaaatcatcaacatagaagtctgagatcttatttaaatctctgactttggaatatcaccagctttcagtgcagaaaggcactggtggtcaaagatatgctgacactggcagaacattttgcattaagttgaaaatttaatttatttacttatgacattaacttaataatgccataactcttgatgtccaataaatctgttattgttttaaattttccaataagcattatttgcaatatgatttactggagcacagtcgaatacattttgcatctgtaaaaccacccgcagagtcactggtaggtactagatatgcttattgaactgagtagaaaaaaactatgtgccaaaaaagaatattcatgaaaaaacaattccagtgagaaaccagataatctgtagctttctggaagtttatagagccactacaaaaaggaggaatgaaaagtgggggataagaaacacctcaggacaaatgttatatgttatctcctcagtgccaccagggatgtgctagtcagagtgtgtaagtagacatttatccacacatcgactttagacgcctcaaggcctggcacagtcagatatgacctggagaaaaataacctgggattggagctcaactgctcacacacaatgcttatttcctaaggcccaggaaggaacaggaagaatggaggcccatttcctttttggtataacattcttttcagagggaagatgaaaaacaaaaaaagggtatatgtctatatgtgagactaccatatatatgtgtgtatatatatgtctatatgtgagactatcatatatatgtatatatgtgtgtatatatgtctacatgtgagactaccatatgtgtgtatatatatgttgttgtatatgtatatattagtgtatatatacacataaatatacacatattttatatgtaattatatacacatacatatatataaatgtgtatacacacacacacacacacacactaacaattacttaaggatatacagtaattattgttccagaaactaagaagaaaatagaaaatggcagcaaagaaatggaaaacaatcctttgatttttggcaaactatttttaatttgacatggtatctggaatacttgaagatactctcagtgtaaattagtttattaaatttagcagaattgactatcttttagaaaatataagaaaaatattaatatatatcaatgaagtgaaaaagcaaagcacagaaaactctttagcaaaattctcttcactctgatagtattcagtctcattctgtgagcataacatttttctcaactatgttaatattccatcaaaaaaaatttgttcaagaaaaactgggtttccaatgacttgttaagaaatcaaaatatttcttccttgaataagaggatccgttttttaaaaaatatatttagctttaggagcttaatttgtaaaccatttctttagctactaatttttaagcttaattttaaaactgaattattaaaatataaaataaaaggaaatttttaataaacttggaataatgtctacacaggtttgatcaggagaatcagtggaatagataatattaaatattttcttcaattaaagttatctaaatgtgggggtacagggatggttggggctcatattatcttcacaatgtttgcattccatgaggtgagatggattttaataaaataaattatgataaagtgtgatgagtgcagcagtggggaaatatgcaaaatctaaatgcacttagcatggagaagagaaaaagaaattctaaggacctggctatgcttccttaagtagtgacacctaaactattgcagttgttcttgttgtggttgtttttcagtagttgctttggttcttagttggtttgttttctaatatggatacaagttctttaagctttcatatataggaataatataaaagggaggaggaaccatgttgaaaaaccatgattcacagacatgaatcagcatatagcatttggggaattattactaatttggtatggctagagcaatggtttccaatcagaagtgattttgcccccacagggaaatttggcaatggctggaaacatttttggctttcacaaagggagtggggaacagtactacagcatccaatagggagagaacagggatgctgctataacatcctacggtacaaacaggacatcctccacagcaaataattacctaggccaaaatgtcaataacatcaaggttgagaaatgctgggttagagcatgaaagcttaggtgataaaaagagatgaagctcaacaggcagagtgtccacattatgggggcagaaggaggagctgggatggctttgaatacctgcttcaggaacaaatgagtagcatgagtattatcagtgatgaagaaattaaaggaaagatgcaggcccaaacacaactgcataggtgtgaatggcacagctaaggagtgcattcacagaggttacagtgcacttagtttttcctggagttgtgcagtgagcaaactgcaccatcagtctcagggaagaaacctttttgcagatgtaaaacctgaagaaactgtgaaatctgaaatgattgtaaagtatatttagattgagatgtttcatatgaaaatgcattttcttttttttttttttttttaaaaaacgtgtctagttttagaaattacggacttgattaggagaaaggattaagaagggcatatagattggtaaaaaaatgggaaaaagtttcggggacaagaaagatcaagaattatgtcataaaaatggtgacacaaatagaggaactagtatgggaggtgctgagccatgaggcaggaaagtttaacattgcttgacaaagagatttggatactagttgttggaagtttagatttcatgcagtaggttagaaaaagtccttgtaagttcctgaacaggagagagatggatgaaaatggcctttgagtaatattgtttttccagccgtgtgttagatagatcatagcatgaagaaaatgaggcatgacagggtgatcagctaggagactagtgaagttctgccctcaatttacaaacaaaatagctgctcactgctccccataaaatattcctttatatacatgaaacgtgctattacgtttcctttcaattttcttgggtatgtacacttagtcctttagccttttctcatcaggcacatttcccaacactgcagtgatttattttgctcttgcctttgtactctccaattttatttttccatatctcacttcatttaccatgattcaaattgaacagagtattctaataaagttcagatcaaaactgagtagaaggaaagggtcttatctatttaaaataaaatatttattttttattttttaaggaattgaagattaagaaaaatgaaaagagtgggcttaatccaacattttatatttttaattataaatattgagtaacaagatatgaataactgattagtaaatgtataagctactgtattaaaaggtatttttttatttttatttttttgagacagagtctcactctgttgcctagactggagtgcagtggcatgattttggctcactgcaacctccacctcctcagttcaagtaattcttctgcctcagactcccaagtaactgagatcacaggtgcccgccaccacacctagctaattaaaagttacttcttaaaatttaaatttaaattttattaatttattatttaaatttaaattttcttaaaatttaagcttgtctttagtgtttatagatggacatttccattcaagcctcatttaaatatatgaaaatttaaaaaaataattgcaaggttattttaaaaaaatatttgccttatttaaaaataaggcaaaattattttaaacttatggagttaagttctccctgtattcaggcctagagaaaaaaatttgacctccttctgcctttcattataaatataataaaaatgtaccagcaaaatacctgagtataaatacatgaaaagacttttttccacaagcccaggacggattaaatgattcaaataataggaagaaattctatatcagataatagactagatttatcttcctatttgaaataagtttttcaagttaaaatatgggaaacaataattctcaagacattttacgttaggcaaagagggcaaagatccctgtgaggtaaaaacaaataaggtgagccttctgccatgtgagtgcttcagtttacttcctggataaagtttccaggcacaacatggggagagggaacccaggtagagcctggctcttttttggagttaaggagataaaactggtcatccagggaatacaaggtggctaaagtttgcagaatagagtatcagaggtgagagacacacagacagaaacctgaaaatctgcatacagtctcccgtgattattcagtagagttctgatcagtgcgtgtatatgtgaaaatcatctgagactcgtggaaaaaacacccaaaaggattagcggaaacatctgggaatagtcctatttccatcaatcagagtgaaaaatcttgtaatttacaggggacagttctcagaaatctttgccccagtggggcaaaatttaccctagacaaaatgcctaagaaacttaatagcaagatccaaaaagaccaaactgtttctaagaaatttaaacatactatagagcaaagatcaataatatttatagaaaaaatatttattacccaataacttaaacatttacaatgaatggcattcaaacaagaagtaccaagcatacaaaaaagcaagacaaacaaacaaaaacaacaaaaatcattcaaaactaatccataaatgacacagattatagaattagtaaaactgtattaaaacatttattataactgtattccatatgtttagaaagccagaggaaaggttgaacatgctaaacaatcatgaaagattttttaaaagattcaaatcaggcttccaaagataaaaagtttcagtgtctgagatgaaaaatacactggttgagattaacagaagattaaacattgcagaagaaaatattagagaacttggaaacagcagtagaaaatatctaatgtgaaacataaagcaaaaagcctggaaaagaaaaatgagtagattgttggtgagttgtgaaacaacttcaggtagcctaatatatgtataaatgaagtgcctgaagaaggagtagggcataaaaatatctcaaggaataatagctgaatattttctcaattttataaaagctatacatctgcagatataataacctcaacaacaaacataagaaacataaaaaagcacaccaaagcacattaccatcaaattgcataaaagaagtgataaaatcttaaaagcagccaaaggaaaaaagacacattttgggagagaggaacaaagacaccactgacagcagatttctttggaaacaatgcaagctaaaagacagtggagcaacatctttaaaatatcgaaacaaagaaaccataatctagaattcttcacctaccaaaaataccatttaaaaacagagatgaaataaagatttttttttccagacaaagactaaatgagtgtaacactagcagacctacattataagaaatgttgaaggaattcttaagtagaaacaaaacattaccacatggaaatatggttctacaggaagaaatgaacagcatggatcagtaactatatgagtaaatataaagagttttttttcttattatttaataccctttatagtcaactgtttaaagcaacagcaataacaatgcatcatggaatttataacatatgcagaattgaaatgtgtgaaaacagtgatgcaaaatttggtaagggagaaatggatacatacttggttcttatatgtgaagtgttatagcattgagtaccatgtgatatgaaatacttcagagatgcaagtgtctgctctgaaaaaggaacatctcttgttttccattgatagtttcttcaagtctaattggcatatagtggtggtgaaaagagggcagggagttttgtcatggtagataccatggaagaaatgaagcccaagatgaaaagataagtttttaaaactttgcctcaaagagggaatgcaaaagttaaaaacacaattcagcatctggttgtacttgcagacagggcaaagttgaagcctgacaccccaagagcatccatcatgatgtattatcagaggaccagtctagtggtatttgatccctagcttccaactagtatgtatttcctagttgtaatgttagatatatttcttactatgagtcatggtcagaatagttggtattcgtttgaggatattttactgatgtgttttaagacagcttcagggattttttttacctagactgattaaggccctagaaggctaaatacctttgtgttgctcagatagcctgatttatgagtacccaacaatcacattgtagttctgctgcccaatccttgttacctggccactcccaataagactcagattaaaaatgactgaccccatgaggaaaaggacccattggctgactctccaagacacacagctgacttatgccctcttcatgatggaatccaagaaaacatctgataacaatggctaacatttaatgagtgtttactctgttccattatgatttaagcagtgtacaagacatcaatcttcatataaacatcaaataatcactttgaggacggtgttaacattttatttttgcaggtgagaaacctgaagcactgaagtaactgcaaattcacacatctagtaaatgatggagttttgattcaatgcaggcagcctgactccaaggttatgcactttatcccaataccaaactgcctcttctctaaactgataaaaactgctctcttttcttgctgaaatagaaaagatatagctttttgaggacccatggctaatcatcaaacaatggttttcctctcctccaacccatttctgtaccagaggagtgaccctaccctgcttggagtgaaaagaagctatacccctgcactcttctctagctcaaactaaggaggaatgaaaggcaacattagataggtatttgcacatgtgtgtttttatccatattctgtgaattggtgtctctgttaaaatatccaatcatctggagaaaagataacctgctttagcttcttctggcattaaaaagtcagtctttcatcagtcagacaaacgtattctgggacaagcttaagtagtggccctcacgcactgttagattttctaacagctgaagggtgaataaggaggaacacaattggaagcagagttaacagagttggcagaagaaatatgtaaaggatttatttagttttgtgttgagggttttgtgatgtcaaggctccataaaatcttaactaaaattggcactgctctcctagagttcttggtaaagttagaatgtattccgggaaatgtagagatgccagtttcaaagaagtggtcattgaaagatagctggattatgctaacattgatttttcacattctattccaagatttttttgtgctcagtagtcaatatctctctaaaatgcttaactttaaatatgtgacattatatcacattaaaatgctatatataactcaaatatagaaagttagtccccaaatattgtataaatgtgtatatatattttcactgaactatcaatgtaccaagtttctccaaattttaaatttaaattttggctaaaaatttcaccaatgtataataaccttcataaagctgagtatgcacagaaccatagatattaagatggtatgaccttcttgaaaatagattatgcttacttaattctaacattcagagctttaagcatgcataaggacttaataaatgtgtgtttattggtgctaatgataagattaaaacgtttcgagggctgttaaaattagatttagcacattgtttaaaaaccacaaattccataaagaaaatatttcaagtacatagttaataatatttttactgcgtttttcaactatttttaattctttaactaaatgtgaaaattaacattttaatatcttggtagtggtttccgtatttcttgggtctatcaacataataataatagctaacctttgtttatttttactataagccaggaaaatgtgttagacacttgaacaagttatcttattaaaaccttaaataactcgatgatgaattcaccattttaccttcattttatatgtacaaaacagaagcttaagtcatcgtttggctaatttcacacacacagaaaataagggggagcaaattcaaaccaccaagttttattccagaggctgtgctcttaagtactgcatttttctttctgtactgcatttctttctttctttctttctttcttcctttctttctttctttctttctttctttctttctttctttctttctttctttctttctttctctttcctttcctttcctttcctttcctttcctttcctttcctttccttcctttccttccttccttccttccttccttccttccttccttccttccttccttccttccttccctttattccttccctttcttcgctttttttttatgctttcagtttttgggtacatgtgcacaacgtgcaggttagttacatgtgtatacatgtgccatgttggtgtgctgcacccattaactcatcatttaacattaggtatatctcctaatactatccctcccccctcccccgaccccacaacaggccccagtgtgtgatgttccccttcctgtgtccatgtgttctcagtgttcaattcccacctatgagtgagaacacgtggtgtttggttttttgtccttgagatagtttgttgagaatgatggtttccagcttcatccatgtccctacaaaggacatgaactcatcattttttatggctgcatagtattccatggtgtatatgtgccacattttcttaatccagtctatcatggttggacatttgggttggttccaagtctttgctattgtgaatagtgccacaataaacatacctgtgcatgtgtcttatagcagcatgatttataatcctttgggtatatacccagtaatggcattgctgggtcaaatggtatttctagttctagatccctgagaaatcaccacactgacttccacaatggttgaactagtttacagtctcaccaacattgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccacttgttgatggggttgtttgtttttttcttgtaaatttgtttgagttcatcgtagattctggatattagccctttgtcagatgagtagattgcaaaaattttctcccattctgtaggttgcctgttcactctgatggtagtttcttttgctgtgcagaagttctttagtttaattagatcgcatttgtcaattttggcttttgttgccattgcttttggtgttttggacatgaagtccttgcccatgcctatgtcctgaatggtattgcctaggttttcttctagggtttgtatggttttaggtctaacatttaagtctttaatccatcttgaattaatttttgtataaggtgcaaggaagggatccagtttcagctttctgcatatggctagccagttttcccagcaccatttattaaatagggaatcctttccccattgcttgtttttgtcaggtttgtcaaagatcagatagttgtagatatgtggcattatttctgagggctctattctgttccattgatctatatctctgttttggtaccagtaccatgctgttttggttactgtagccttgtagtatagtttgaaatcaggtagcatgatgcctccagctttgttcttttggcttaggattgacttggcgatgcgggctcttttttcattccatatgaactttaaagtagttttttccaattctgtgaagaaagtcattggtagcttgatgggggatggcaatgaatctgtaaattaccttgggcagcatggccattttcacgatattgattcttcctacccacgagcatggaatgttcttccatttgtttgtatcctcttttatttccttgagcagtggtttgtagttctccttgaagaggtccttcacatcccttgtaagttgtattcataggtattttattctctttgaagcaactgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatacacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctagtttattgagagtttttagtatgaagggctgttgaattttgtcaaaggccttttctgcatctattgagataatcgtatgttttttgtcgttggttctgtttatatgctggattacgtttattgatttgtgtatgttgaaccagccttgcatcccagggatgaagcccacttgatcatggtggataagctttttgatgtgctgctggattcggttcgccagtattttattgaggatttttgcatccatgttcatcagggattttgaaaccaacgagaacaaagacacaacataccagaatctctgggacacattcaaagcagtgcgtggagggaaatttatggcactaaatgcccacaagagaaagcaggaaagatctaaaattgacaccctaacatcacaattaaaagaactagagaagcaagagcaaacacattcaaaagctagcagaaggcaagaaataactaagatcagagcagaactgacagaaatagagacacaaaaaaaccctccaaaaaatcaatgaatccaggagctggttttttgaaaagctcaacgaaattgatagaccactaggaagactaataaagaagaaaagagagaagaatcaaatagatgcaataaaaaatgataaaggggatatcaccaccgatcccacagaaatacaaactaccatcagagaatactatcaacaactctacacaaaaaaactagaaaatctagaagaaatggataaattcctggacacctacaccctcccaagagtaaaccaggaagacattgaatctgtgaatagaccaataacaggctctgaaattgaggcaataattaatagcttaccaaccaaaaaaagtccaggaccagatggattcacagcctcattctaccagaggtacaaggaggagctggtaccataactgctgaaagtattccaatcaatagaaaaagagggaatcctccttcattttatgaggccagcataatcctgataccaaattctttcttccctttctttctcctttcctttcttttctttttttttttttttttttttttttttttgtcactgctgcccagactggagggcagtggcacacaatctcggctcactgcaacctccacctcccaggatcaagcgatttcatgcgtcagcctcctgaatagttgggattacaggcttgtgccatcatgcccagctaatttttgtagttttagtagagacagggttttgccatgttggctatgctggtctccaactcctgacctcaggtgatctgcccacctcagcctcccaaagtgctgggattacaggtgagagccacggcacctggcctgcatttctttacctataattatctatctctcttgacctctaatgtcactaattcataaatagcaaaaaagtctaaatacttctcctcaaattaggctaacctctgagtttttcttgctgggtattactttcctagtttcctttcttcaaggtactttcaccaacataaagcctcttgtagcaattagttaaatttgataaattttatcacttattggaaggatagaaagtaactttagcaacaaaaatatgaaaataagcatgaatattacttgaagtcaaagggtagttagagatggggtgatgattctttgtttaaaattaaagccattactttttatacagttggtgattatcagagagggacagagagaatggggcatgcaatagaatttgatgaatattttatagttggtgaaaatagaaaagcagttactaaacactgccagatgatgtgctgctgtaggatccctgaagtggtagagcagaatgaacatactggggtactttgaggccaagtacagacatgattaaaaaatctcgttaacagaaaggccataatgaattatatttatagtaatattgagataataataatatcatttgaaagacttttggagacattttagcgtggataaacatagttattttccagaataatgattttgaaaataactgttagcattatgtatttgagaaaacacagcggcaacaactgtgaacttgatgccaatattttctgactttttgtttttctggttctatagctataaggtaggcatattttcaacagtaattttaggaaataaaacagcttgagatggaagattattaatgaggaggcttatgaacattccctgaatgtttaggaatggatatataaatgaacaccattatgaacgcattaaatattaatattgatatttaagtatatattttacttatcattggacctctgtctaatgagcatataggttttattgggtttattttcaggcaacgctcttcaccaatcaaatgaataagaatgaggaatttttgcttactttaggagctatgggtgtgcgtgcatgtgtgtgtttgtgtgtgtgtgctgtttctgtatgggtaatatttaggtgtagtgttttgtctatatttatctaaaaacttatgacttaatgacaactcatcagatacaactaatgagtttagcagaaaaattggattaggccattttttcatctgttttacaaaaactgatataagccagtttaataaaagggcacaagcttttctctaaatggtaattttataagacatttaaaaataataattcaatctacttttatgtgggtcatgatttatgtgagttatgtgaatcatgattcagcaaaattttatttggggaataagaatatactattctctttaattctctctttcattagtttgaataacaacttagcaccataatttacagacataatgttttctagttttgatctgacaacttaaatctaacaattaataagataatttataaataatcaggcccattaggacagaaatgctttccatagcaattatgtgcagctaaatgtttcctcaaggaaacatttgactctatgtccatgtgcatgcatatggaaatatagtgttatttagatataaactaatatctattgtttaagctaatattatataatagatatctgagtattcagaaacaacttaaaaatgtgcttttagtcaaaaggataattcctgaaatttattaccttcatttaaaaaatataaatttccttatgtacttcaaaaagaataaagttatggagctgtgtaaatttctctattgagaaaaatcaatattttataaatatttttaaattatagaaaaagtaaggttaatatttgatgttttatacctaaactttcaaaaatataatgttctcttgcgtctgttttcttttaaaatctggttacactgacttcagatataattaagaactctgctttgttatatttggaaaatcaaaacataccagatttgagctgatagaaaaagaaaatgctcttgctcagagtattacaatataaaatattgtagagggcaatagtatattcaaaacctttttctttgaagaaataaaaaatgggtaaagacttgtgtttgcagtttgtatgtgtatcatttagcagatttaatattttaatttttcagttgtttgcttgacattggagtatattttatccttcctttaaattgttacaggtgacatatttatttttgatacaataagtgaattaaaatgggatttatttgcatatttttatgtatgccctggtgggtagcaaaattatgcttggaaatttctggcttcagtaagttttttagtcttcatattcacaaataaataatctctttaattggatcaaagcaacttacccaaggttcatgtgaattctttatcagcaggattattgtattatgagaatctgagtttcatatttacagtcctgtgtctgagataattggattgttttggtaaagaattgtgctaacaaaaggaaaatgaggcagaggaagaaaagaaggaacttgatacatacaaatagacacgaatacaagaaaaaagttaggcactacattaaccaatgtgagatataaaggaatatgaataattaatttgtttaaagcagtgtacctccagaaaaaattttggtctgtatttggcatcgtcaaatgccatttaataaaatagcaccagaatattgattaagtagtgttgctttgaatggtacagttttatgctttttattccctgggcaaagtaagttattattcctggaagaaataaagttgggcaaagtctattacagaatcacactagtcaattatgctaaatttctgcccaggatgctgactgccttggtttaaactgttagtctttacctcatctacagtttcttttccttcaatagatatatattaatctactagagtgttccagatatatttttaagtgctagagaacataaagatgaatgagacacggtccttgtcgttatgaggatcccagtctactaaatgagaagtattgtaattttttaaatgggcttataacattaatggctaccattttaagcactagtcatgtattaggcattattaaatgttttcaccaactcccttaacatttccatggaattaaagaaaaagatgaagccaggaggcttctgaaactagccagcaacacacaggaaggaaacaaccttgccagcagagctgctgaggaaagaccttaagacatgttctggaaggatccagtggctggaactggaatagtacaaataccagttaatatctaactgataaaataaggcatttaatatagggtgcttaagatttcatactttatcctcagcagaaatgggaaactactacatatttttgtatggattttattgatctctcagcgatatctgtcacattttctactgtggttcctaaaacctttgatacccagtgtctccagtacagtgtcactgtaataacatatcttctatcgtaggtctgcacttactctttacagtttcagtgtacaatttacagtttcagtgtactttcaaaataagtatcttaaagaataagatatcttattcttacaggaatctgagatatgtagcacatactttaactattttggagaagggagaaatgctgagtgttccagcagctatcataataacccttgcatatttttcagtagcataagattagaattatgggaacaagaaggagatgcagccatgtgggatggaggagaagcaagagaagtgaatgctgtgttggggctggggggacccaatgctaaggacaactgacaatcacttcaacatctcccatctgccaacctcactagcaacatcacttctatagtaaactaccatctggcatggctaagaaatgagatgttttactaaataacgtactcagtttaatagaacttttgggttgaattatgtgctttcaaataagtagactaaaggacatgtagtataaaattatgcagcccatattttaaactttctttgaacatctaaaactacttcaggcctactcagtcccttggatcttcataaatttgggggaaaaaaccctcatactttcaaggcaccatgtctgacactgggaatgcaaagatgaaatcctatagcccctacccttaaggagctcgccatttagccaatcgtgcaataattacattgattatagagcatctgagtatttatgtcaaggtacatgaccagcctaggaataatgatggaggtatacaggaagacagaatggaaaattaaacccaagcaacatggaaaacaatgttatgagctgtagctaatactatagatacaacaaaattgaaagtaatagaatgttctagttgaaaatttattccacgggtcctaaagtcacccctttgtagattacttgtaacattacttgtatttttatgaaatacgtgatcactatgtaatttttgcatggtattgactaagacaagagagtaatttcccagtcagaaaatgttattgttgcatactgggctaacccaccctcttgtagtttgtaggtgccaactatgaacccaggttttgttgttttgattcatcgatgtttacgctgtcatttttttttagcttttcctgcttcacactaattatactattcactatcctgcactctgcttttcactttgcttccactcctgtctcacgctgagaaaccatttcacacctgtatcaatgcagtgctctctattcgtcatcccacatctcactgcagttaaagtaaaatttttgaatgataagcctaatcatgtcacttcccctcataatatctattagtggccatgatgataaaagcctataacatgtctacaaggccctgcagtggtctaatccacgcctctccttctagcttcatcttgtactactgtctccgtgctcactatgctacagcaacacttgcctgttttcaaatcctggaatacatcctatggcatcttgtctcatagcttttcacatgctgttctctctccctacaatgctctgatacccctgcccccgaaccctacctcggcttccttaatacttatttatcctgatgtcagtccaaatgacccttcctctacaaacatttttcttgtcctccagaaaaagctggttgtctttgttggtgtgccatgcccattcatagcttgaatatcaatctgtttttgccattttaatataattatattcactcattgaacaggtatttattgaacatttactatgttccagacactggagttacatggtcttatgtccatgtccatgttacatgtaactggagttacaaaagacaaagaagccctattttttttaacgaagtttatagtttaatggttgaaaaaaatgaaatgaataatactttaaaaactgaatttcacacatagtttctgtagatgaaataaaacaaggtgatttggtaaaaagcacaaagcagagagggacaagtgggttatttagagtggatatcaagtaaggctttctaaggaagtgacatttggactgtgattttattgctaagagaatgccaatcacaggagggccaggtggcagaactttcaaggaaagggaaaggccagtgaaaatgtctgtctggaggcagaaacaagcatggcagttggaagaagaagaccagtgtggcagatttaattaaaattggccgtcacgtgcctgtctcctccactagactgcaagtgtctgtagggtggggctctgtctcctttatgtctgaagtttattgtacaaaatcacactttaaaactctgctcagcagttaattcttttgggaagaatttgatgtcttctctcctgctctctgcccatccccaccacagaaacacacacctgcattcatcctgggtagaaatgactgctttctttttgtaattcaatgctactgccttcatatattttttcttaacatgtggaacattttctcgtatttgtttgtttttatacctctcacttctaacaatgtcttgagagtagggactatttctgattcagttacatgtttcaaatgcctagtgtaataagctcttaagcatgcaatcaaattttgttgcaatgaatgagacaacgaatatatactgccttatctctgctatggcttctatttttgtcttggtcaaggtttcttggaaaacagaacctgaggttaggtaccttaaatggtaatgtggttattgagatgtacaatctcagggccaggcaaatggaagtgatgccaggcaggatgagaatgagatgatgttacacaactggctctcaactagttgcttggccatatgagatgtctccagataggctgtttggaaaatccacccctagaggagtattcaccagaggcatgatagagagggaatttatctgctgacttcctcttgcctctagttttctattatttatcaatgtattgatgttaactcccctgggtcaactggccccacgggtaccctatggagaagtaagatctcttgcctgtacttcatctgggaccgaaagcaatgggaagaactggagattcagtgttggtctcaggcagttggtcaacaggggcccacagggtcagttgtggcagtggcagctatggtggaacaaatggccaaggacatgagattgcaggcaaatttgagctgctctgagaaagtgcataagaagtgactaataaaatctgcaaacttgattttcttctaagctctttcttctccacccataaaaatatttaacttggccggacacagtggctcatgcctgtaatcccagcactttgggaggccaaggcaggtggatcacctgaggtcaggagttcaaggccacccagactaacatagagaaaccccgtctctactaaaaatacaaaattagacaggcgtggtgacccatgcctgtaatcccagctacttgggaggctgaggcagaagaatcacttgaacccaggaggcgaaggttgtggtgagtcgagatggcaccattgcactccagcctgagcaacaagagcaagacttcgtatcaaaaaaaaaaaaaaaaaaatagaccagttacggtggcttacacccattatctcagcactttgggaggctgaggcaggaggatcacttgggcctaggagttctagatcagcctgggcaacatagggaaaccttgtctctacagaaagtaaaaaaattagctgggcatggtggtatgcacctgtggtcccagctactcctgaggctgaggtgggagaaatgcttgagcccaagaggtcaaagctgtagtgagctatgattgcaccactgtactccatcctgggtgacagagcaagaccctgtttcttcaaaatattaaataaatacatacataaatgcatatataaaatgaaaacaagaaacaaacttctgtgaccccaaattcccttttaatttcctcttagttccctctctcctttctaccaaaacttttgttccatgtgtctatgcctcacccttgacacaccatggagggccagccccctttagggttttacatctgctgtgctcttatatggctcccatctctttggtcttgctgtcatctgcgcctagagtgatcttttctacttttttatgtctttgtaactcggaccaaatgtcatctatgccacttgctgacccttttcccagcttagtctgaatgtcacgcccctccttacttaaaatggcatcctgcccttccctgaatcataatacttatcacattggtttaatatggtatgttttatacatccttccaaaaatattgtgagaccgaattctctcacttttagattcatctttgtgtattgatttttggttcaatgtcttgtccacagtaagtagtaaatacatgttagctaagcaaaactatactagttaagactaatagaataggcgactgaccagaagatcttatttaattttaacctggaaaaaaaggccagaaaataatacataaaatttcaccttataattaataaactcttgatttaattgtgatttaaaattatattatgaaaatatgttaaagtgatgattatctgtgatagagtcttcaagatggccatgatcaattatttcctttcctttgtgactttgtttcttttccatcaagaggttgtgtttattcccttccccttaatttcagaattcaggctgggtttataacttgtcttggttaacagaatgtgaaagaaatacctgaaaggaggtgaaaagcttccactttctcttttgaggcattcagctgcaatatgagtagtgtatcttcccaatatcaccatgtggtattgtgagaatgactaatctagtcgtgtgaagagaaagaggtcacattaaaaaacaaacaaaacaaaacaaaacaaacaaacaaaaaccctgacttgtgacctgacatgaagctttttgaacttttccgcccaggtctgcagccaagtaaaatgcacccaaatgagtaatcccagccagtgccacctggaacagaacaacctctcagctcagctcatctaacctacagaaccatgaaaaaataatagatcattgttctaatctacaaggtttagggtgatttgttgaatattgatagataatggaaatacccatatttagcttggcatttcctttaaaaatgagtcttaactttatgacttagtaccaaaatggttggcttctgataatgaccctagaattgattacagtcaagcctgatcattcagtttacaagagtccaccaagtgtttctgtgaaagtagaacattatagaatgcattataagatgggcacaacagaattgtgtgcattgctttgtggccatatgcacacagtagactcttattagtggaatgatgagtacataagaaacatgagaaaaataatagctggtggggaagactctaagtaaaggaaaacccttgacatcattaggagtaaacttgctgtattagggttctccagagagacagaccaataggagatatatatatatgagagaggcgatttttttagggaaattggcttacagtattatggagactgagaagtctcatgatagacaataggctgtctgcaagctggagaaccagggaagccagttgccttactgtccaaggctgaaagccttagaaacagggaagcctgtggtgtaactccatttgtggatgaaagccacagagtccaaagaccagagaacctggagttttaatatccaggggcaggagaaaaagggtgtcccagatccaagaaagagtaaacaaatttgccttttctctgcgtctttgttcatctgcatgcttcactaattgaatggtgcacacccacattaaggggggattttcctcactaagtgtacagactcacatgccaatctcctagggaaatactctcaaagacacatctagaaatcatgttgtaccagttttcttggtatcccctaatccagtcaagttgacaccttgcttacttgcaatcatgcaactttctaacaatatgttgaaaataatgttagtaataacaataacaataaaaaagcacattttattgagttcttatatatgtctagaaaatagtatctcatttaatactcagaataaccatatgagacagttgctataattatagctacttcacagttaattaaactgaaatatagagaaattgagtaacttgtaccaagccacatgacaagtggtagagtctggctgaaagcagattgtctgatactagacccctcaattgttaactgctggttatactaatatataatgtctgttagcataatcacctattatatatatgtatataaatgtgcaatattcataattctactgtgtgtgtgtgtgagtgtgtgtgtgtgtgtgtgtgtgtgtgtgtgtgtgtgtattatgcttttctttaagcaacaaatgctgccatgacaagatgttttggaataccaaggtcctctatatttcaatgtcgaaggtagtacatagctttggtaaatgacttccctttactgatagcctgactgtacctactttccccttccttctatcccttatttggatgttgtaactggaattaccttctccagtcctccttgctgctcattgaacagctcatgaaccaactgggctatgtatatccattattaaagaacaagaacctgatgttaggacagaataaaggtatttgagtataatatgtaatctattattttctcattacttctacctcaactgttattccttagttctccaaataggagaaaataatttttacctcttttgaaatcacaagcggggttgtagaagtgattttaaacattcaggcacatactcccatacacacataacaaaccctattccacccatcagcttaatgttcttggcaatttatttaactcacactgtgggcaaccactgccagcttcaattggcttgctgcctttattgatgttttcaggacccaagacctttttattcatgtttcccattaatctcagatgctttacaacatttctaaagacaggaaaacatattgggtcaaatttacagctatctttgaactcagtagttgaatctgctaagtcaaacccaggtttcagccagcaaagtagctttgaaatgctagtttgaaaaagactcaaaaagctttcttaggtgtcagttcctcctgggagaaaagagacaggaatcgcattttaatgattcaagtctaggtatatcacaagtgcagcctgtttattttatttttagtggagtgagaagaatcacctattgaagatgctttcttatatccacatatttattttatttttagtggagtgagaagaatcacctattgaagaatctttcttaaattcacatatttagtctgtttttttaaaaagtttaaacccatcacacactacagaggcaagatatttttataaatcacatgctttcatcttacatgatatcttagtaatacagtaattctttaatataaggcttacaaatattttaaaaaacttttcagcataattcttttgagaatagggctagtattggtcacaactataaaacatggcatttatttttggttccctgtcatctttcttccagtcctttgtattacccaccaggtatacctaccttggggcccatctatcagtgcttcagctctcagcaataacctattacttttaaaataaagggtgttttctctgggcaaaattaagaagttagtcagccctcctttgatctttatgacacttttcaacatttcccacccctgcttactttctcttccttcaggtgttagaaaatctttttaaaatatcccctctcactccatcagataggggaattaacagcaatatttattattttattacctaatcataagctaaaacaaatatcttttaaccaaatatatatcaaaatttgtactttaagttcaatttctgagttttaatggtggcaatgttaggtttcagcctcctttaaatatacttttgagtatgagaatatgtgtgggggtatgtctcaaagataaggaacccctggagttgcatgtttaatccaaaggtagacttgcaagtattactgacttcagaatgaagcagtgtagtggggaagggaaaatctcctaatgccttcccaaggaggacaagcaagtgcaggtccagccaaggcttcttacctaggtttcccttgcatttggaagatgtatcagccagaggtcagctgcagataaattagtaaaaccagcctagcaattttaagaagaaatggcttaaatatagggaaatatacaattataaaatagttggaagtactgaaggacaggctctgggatggcctctgtaattctaccacagaccaggccctccagggatgctgccaactgtcaccattagaaaggtgggtgattgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaggtgggtgattggaaaacagccacttcccggttgtcttagatgaaattccaagatcaggaaactgctgcactatttcattagaactgcatcagctgacattgaattcctagaagccatggcttccctctcaatctcaattcacattcaaataaatgatttttctttaatgacaaatgactgtcagaacctaagtcactttcagaggtgtagctgcaagggagtcttgaaaatgcagatttttagctgtctgggccttatagtacagaaaaaggtgagaaaagatgccaaaaggagtcaatcctgacatattttttaaaaatgcaagtgcttgagtcatttttatgacccctgatcaaaacagttacacattgcaaaaaaaggcattgcctagataaacaaaatattcttgaatcatttgctctaaactaggatattatttctaggcctttactctatttacttggaacactttttctgtctgtattattgatgatggcaattagatatgaatatctaatatgtttgtcataaggaaagatattaattgtgttaataagattcagtaatgatataatttaatgccatttgtttctcatagttaagttctagatttcaaaaaatttttctattaaaagattgataattctcaattctgcaaggaagggagaacaacataaactgattttttattaaacccgagaaccatttaggaataaatgattgatatgttgaattgtctcctgcaaataggtgaagatacctgaaaaataaaacatggtatctttcattcttactgaggtgattaaatgagaacaagtatggctatctgaattatccctgtgaactttaataagctactctatctattagggaatctgaactgaagactatgcaggcatacaaaggctcctaagttcagtacaattaagggggaagaagagggaacacattattattataataaaaaagtaaaagtgcaatttaccccagtaaaaaaaaaggcactacaaaaacctgaaaatagtagaggaaaagtgcttttaaaatttttcaattatcaataacaattgaaagataatataaaattcattaattatatagctgaaaatatatactaataagagaataattacactatactttagtggaactgagcaaaatgtaaatattataaagaaacaaacataaaatatatatttaaacttcagtacacaatatgatgctattgtagcatttttccatttgtcgaaggcaatgataaaagtgaaaactgggctgggtgctgtggctcacacctgtaatcccagcactttggaaggccaaggctggcagatcacctgaggtcaggagttcgagaccagcctgaccaacatggagaaactccatctcaactataaaaaaatacaaaagttagccgggcgtggtggtgcatgcctgtaatcccagctactacggaggctgaggcaggagaattgcttcaacccgggaagtggaggttgtggtaagccaagattgcgccattacactccagcctgggcaacaagggtgaaactctgtctcaaaaaaaaagtgaaaactgaagtgaaagtagtaatatgtaggaaattttatgattttccaaatgtgtataatggattttcatggtgaactgtgttttgtattcaaacacaagaatttttaaaactcagacaaaaatggattaattcttaagtgtctcaggggaacttaactggaaattttgtgtatcttatttattgaaatgctataaaataggcaaacacatttaattgggattcaggcggtttaagcacagttcagtattacacagataaataatggacctgtacaaaattgaactggtgctttaaaatccacgatcatgcctgtaatctgaacaccttgggaggccaaggcaggaaaatggctttaacctagcagtttgaggctgcagtgagctatgattgcgccacttcactccagcctgagtgacagagcaagaacctctccctaaaagaaaaaaataaaatccatgatatttcttttttttctttatgttttattttatttattattattatactttaagttttagggtacgtgtgcacaatgtgcaggttagttacatatgtatacatgtgccatgctggtgcactgcacccattaactcgtcatctagcattaggtatatctcccaatgccatccctcccccctgcccccaccccacaacagtacccagagtgtgatgttccccttcctgtgtccatgtgttctcattgttcaattcccacctatgagtgagaatatgtggcgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcattgtggttttgatttgcatttctctgatggccattgatggtgagcattttttcatgtgttttttggctggataaatgtcttattttgagaagtgtctgttcatgtcctttgcacactttttgatggggttgtttgatttttcttgtaaatttgtttgagttcattgtagattcttgatattagccctttgtcagatgagtaggttgtgaaaatgttctcccattctgtaggttgcctgttcactctgatggtagtttcttttgctgtgcagaagctctttagtttaattagatcccatttgtcaattttggcttttgttgccattccttttggtgttttagacatgaagtccttgcccatgcctatgtcctgaatggtaatgcctaggttttcttctagggtttttatggttttaggttgaatgtttaagtctttaatccatcttgaattgatttttatacaaggtgtaaggaagggatccagtttcagctttctacatatggcgagccagttctcccagcaccatttattaaatatggaatcccttttgcattgcttgtttttctcaggtttgtcaaagatcagatagtcatagatatgcggcattatttctgagggctctgttctgttccattgatctatatctttgttttggtaccagtaccacactgttttggttactgtagccttgtagtatagtttgaagtcaggtagcatgatgcctccagctttgtccttttggcttaggattgacttggcaatgcgggctcttttttggttccatatgaactttaaagtagttttttccagttctgggaagaaagtctttggtagtttgatggggatggcattgaatctgtaaattaccttgggcagtatggccattttcatgatgttgattcttcctacccatgagcatggaatgttcttccatttgtttgtatcctcttttatttccttgagcagtggtttgtagttctccttaaagaggtccttcacatcccttgtaagttggattcctaggtattttattctctttgaagcaattgtgaatgggagttcactcatgatttggctttctgtttgtctgttgttggtgtataagaatgcttttgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgaatattagacacatcaacgagacagaaagtcaacaaggatacccaggaattgaactcagctctgcaccaagcggacctaatagacatctacagaactccccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactgaggattaagaatctcactcaaaaccgctcaactacatggaaactgaacaacctgctcctgaatgactactgggtacataacgaaatgaaggcagaaataaagatgttctttgaaaccaatgagaacaaagacaccacataccagaatctctgggacacattcaaagcagtgtgtagagggaaatttatagcactaaatgcccacaagagaaagcaggaaacatccaaaattgacaccctaatatcacaattaaaagaactagaaaagcaagagcaaacacattcaaaagctagctgaaggcaagaaataactaaaatcagagcagaactgaaggaaatagagacacaaaaaacccttcaaaaaattcatgaatccaggagctggttttttgaaaggatcaacaaaattgataaactgctagcaagactaataaagaaaaaaagagagaagaatcaaatagacgcaataaaaaatcataaaggagatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccatctgaaactattccaatcaatagaaaaagagggaatcctcgctaactcattttatgaggccagcatcgtcctgatactaaagctgggcagagacacaaccaaaaaagagaattttagaccaatatccttgatgaacattgatgcaaaaatcctaaataaaatactggcaaaccaaatccagcagcacatcaaaaagcttatccactgtgagcaagtgggcttcatccctgggatgcaaggctggttcaatatatgcaaatcaataaatgtaatccagcatataaacagaaccaaagacaaatccatgatatttctatcatgcttcttgtactctcttctcggaggaattgctttgcattttggctaatgaaatcatgtcccctctttactttctctcaagtctatctcttttactgctttcccagacagatcagttttagcttaccatagcaacctctgggacttgacccagtctttgcagacctgtcagatcagtgttctctcttgagcaaattccttaagtgactctttcctatcacattagatctaacttgctctttttgaattctctaatagggatatgtttaaattagttgaattaatttttgctgctctttctgaatgcacttctgtgagtctaatgagtctaggcttctttaatttaaataaaactataatgcttattccagcatctatacctttatttacaattatccctttgatcaaaatatctgtctgtcatttattcagttaccaaatcctcaacacttctggagatcctaggccaaacttttcttatctatcaatgagttctctgaccactaggtctattttaatccacccgctccctcacttctttactctcttgttgcatttagaataattctgtcttatattgtttgctgttaagttcatgtgttttaatcaattgtcctgcaaaaagctgtaaactccttgaaaacatgggctgtgctttcatcttcttaattaaaagcaataactagctcataggtcactttccaggagttttcaatattatgctttagctctaataaaatctttataagagaatataaatgacctagaaatgttaataaaatatacaccacttaaaaagtatgttgattaaagtgaaattttagaaatatgaattaaaaataagtaataaagacaaacatcacaatgagctttaccttaaaaacatcatctgaggtagtacaggaaattatacagagaatatttgaaaaaaaaaatatatatatatatatataatatatatatatatatatatatattttttttttttttttttttttttttttgaggcagagtctccctctgtcacccaggctggagtgcagtggcacgatctcagctcactgaaacctccacctcccaggttcaagtgattctcatgcctcagcctcctgagtagctgggattacaggtgtgtgccactagggaaaatagaattttaaaaagcaaaatgactaatcaagtctgtgtagatactgactgataagtagaaagtagaacatttctcactctctctcagcattagaaccctgagatcaacattagccaagtcatgaatttgtaggtatatgtagaattagaaagaagcaatttggaaacaactgttaaataattgattgatttatattaaaagagatgaaatctgtaatacatatctatctgaaggtattataatttgaattccagtccctcttattttaggggttaaatggatattaagggagtgtgaaccagtggttaaaatctctttgggacttagaagtatctgagataaaatcctgtctcttctattaattaaggtgtgattgtggcctagttacttagcttccccacccagtttcagtctttataaaataagcataataatagtgtctacctcatagagtgagtagaagattaaatgtgatacagaatttatagcggggaaaaattcttggcatatgaaagtattaaatacatgtttgctgttattgctattattattttcataaaatatattatcttttacattcactcagaaccagagccaatatttctataaactgtattgttttggaattaaatgaaaagttgtgtgataatatgttactcgtttcaatacataaggaatttatacttcttccttacaaaaatagaggttttgagaatattcctcattatttcagaggtgaaacaacagaatatgacagaaaatactgaaaaatactattgtaaaaaagatgcggttaaatcatcattggccattgcaagtaaaattttgggattaagtatactgttaaattagtcaatatgtacattttaactgaaataaataattagcttagataatacttctaacttaagataactcattattctcatttgaacttaaaattcttccactggtggtaatttgaaatgggctataatcccattggtaccttttttatgacaagggttttggatcctcctgtcagaattcaactcagatttaaaaccagactctggtctcactttctccattagataacaccaaagattgccctatttccctttagaatttattatttatatcacattttaaaaaatttggtaatttgaggccttgtcttgcaacttactacctcatggatatatgtcttaacaactcaattttaattttatagaggatagattactcagtattctcatctgtaaaacagatataataagggtgtctgcctgatgagaatggtataggaatcaagagtaaacataagtaaaatgcttagaagagtgtctggcatatattcaaacctatttgttaaataaaaactagatttcttttgcatttttttaatcacctatactatgctatttttgacaatgaaaacaaaattgtacttgaaataatcatgaagaaattggccatttgggataataatgtacttttatgctgaaggctgcttttaactaatacaaatgcatccaatatagataaattagtaaaatcttaatgagataaataaatcagtttgcctttgtaaaactttaaatgtatctaaatttagtgacttaatttagtgacttttccaattaatttgttgtctacaccatcttctaaatatactacttaaattcctgttcccatgtcttaacttttgcagttatgcccaaataccttatgcttccgctcctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggaggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgcatagaagagtttaccagggtcagtaaattccaactcacattaagaacattaggagaggtttaaaaatctttctggaccgcaccctgtggaaattcaatttttaaagcttcccgagttaagtctaaagtgtaggtagagttaaaagccacttgaaggcaggcatggtggctcatgcctgtcatgccagcactttgagaggctgaggcaggcggattgcttgagctcagaagttagagaccagcctgggaaacatggtgaaaccccgtttctccaaaaaatacaaaaattagtcgggtgtagtggcagacacctgtattccgagctatgcaggagactgaggcaggagaattgcttgagcccaggaggtggagattgcagtgagccaagatcgtgccactgcactctagcctctaccctgggctacacagcgagactgtcttaaaaaagaaaaaaaaaaaccacttatctggggagaggagtaattaacgaataaaagttgttctgtgacagtcttatggaattagttcccagagcaactgatatgaaagataatttggaacttcagaaaatatggtgttttgctagcagagtcaagggaaaatttgctataaagaggctgagttgtgcagtttgtaatctgaattgtacagaatctgcagttcataatcagtttcagcttttgctgagaatttgaagaatgccataaaaatatttactggatttaacaaaatggagttcattggttttggcaaagcagatgacaagttgaaaacagattacagtagaaatagtttattctatatagattatctaatttctattttttcccaaaaacaccgtggttataatcttttgtctaacatctgttggattgtcattttcttactgatacataacaatgtcttgtaatttaaacattactgaatttattacatattttaaagtctttataaaaattgctttgttgtcttaattttatttttaatttaatgttcttttggttttgtcatttcaaagtttaaaatattatgcagtagaatttaccaatctgatacagtaaactaagggaagacactgggcaggagcaatttatacacaatgagacaaaccaaggaagaaaattttaattaaatttttcttatgtgtaattgaggatattgattaaaaattgatgactttccattttcaatatggtgattattaattttgcttcttttgtcttcctttcatgtatgaatatttgtactgttctaacatctattaccttaatttaatggctagtgaacattattttaatggaaaattctttaaacgttaaggcatttagtgaggtagataatagaagcaaataaacactatttaagatttatattattatctaaccattgcacaaaaggcatctcataactctaactcatagtaaaatgagtatattgatctctccatttcccaaatagtgttttaaagataaaatgaataatatgtcttcatcattattaaattattgtggagatatttaaaattatgatagaaggtttaggattcttaatggactataggttatttataaaaataaatgaatggattgcatttagaaagaatatttataaagctaattttcatacaactttattttgccatccaaataatattttttggacaattgaaacctagatctctgaaaaagaatttcagtctgtactcataaaaatactatgagattatattgctgagttagcaccatgagaacagtgtttctgcaaattttttcttctaggtgcccaccccacagcagattcttcaccaatatttgttagaatttaaatttagcccaattctttaaataagaatgcagagatttcatggtctaagaatagaacaatcagcactctttgtgttctattttactgcttcataaataaagttcttcagtccaagacatctgaacatgtatcagaatattcactaattattgtgaacatattttaaaatggcttaggctacagattctttccttacaaatccatcccattgtttggggaatccaattgtagggtgcttcatatcaggacaaaaaaaataaattagtaaacttgtttctttttctaaaaacgtcataatagatttgcaattttccattatatatttattcagcttatttttggaagatgttggtcttgttaagatatcactgagaatactacattactatgtacaacttatattctgggaactgtaagtaacatttagctgcttaccccaaatggccaagtaaatgaacaactgttatgtcttatcttagaaataaaggttcacataatcatctttcagtgcagagtattaacatttgtttgagaagagctcttcagtagaaaatatagctaatatagacactattattctcaataaaaccaaaacaaagctgtaactctgagtctgttctctttcaccccattgcctctgtaggagaaaacataacgaaagctccagtgctcagcaccagctcatgagcacatttgcctcacttagtgtttaagattgtatgcagaagggcttcatttttagaattaacaatggtgcaattcttcattaaaacatgtatgcctaaagaacatgagcagacacttttcaaaagaagacatacaaatggccaataatatattaaaaaatgctcaacgtcagtaatcatcagagaaatgcaaattaaaaccacaatgaaataccatttcacaccagttagaattgctattattaaaaagtaaaaacttacagttattggtgaggctgcagagaaaaggggacgcttatacactgatggtgggaatgtaaattagtttagccactgtggaaagcagtttggagatttctcaaagaacttaaaacagagcttccatttgacccagcaatctcattagtgggtgtatacccaaaagaaaataaattgttctacgaagaaacaacatgcacttgtatgttggttgcagtactattcacaataacaaagacaagaaatcaacccaggtgcccatcagtggttgactggataaagaaaatgtggcaaatatgcgccatggaaaagaatgagatcatgtcatttgtggcaacacgagtgcagctagaccataagtctaagtgaattaatgcaggaatggaaaaacaaatactgaattttcttgcttacaagtgggagctaaacatttagcattacacacggacataaaagtgggaacagtagatactggggggactattacagcggggaaggaggaaggggacaagggttgaaaaattacctattgagtactatgcacctgggtcacaggatcactcatatctcaaacctcagtgtcatgtaatacccccatgtaacaaatctgcacatgtaccccctgaatctaaaatgaaaattgaaattaaaaaatgtcttccaaataattttttaaatgactatgctttctacaaaaatagaagaaaaaaattttaaaaaaattccctctgggttaaacatggtagagaattgtcacacaaaagaagcatttgccagccatcatttgcaaatttcaagatgtctaggaatctcataaggaaattgtttaaaatgattatttacagcctccactgccagagattttgatctcatcaggttgggatccagggaactccagagactgcatgcatcacattttgacaaacagtgaaaaagaatcctttttttctttgtcttccacgtgtttaaaattaggcagagagttggtgtttcctctttgtgcatacaactagactagatttaccagacattgttacataaggcatggccatataactgagctgtagacaatggaaagtgagtggaaggcaattattggtcctgactcataaaaccttactcaacacacttgtccaagctcttttcccctttcagcctagcttaagtggaggtgaccactatggtggcattgaaagtcaacaaaatgtataggagcaaacatcttctaagttagcagttctcctcaacttcagcacagacacaaatcaaatcatatgcttgttaaacccacagattataaaattctaccaccaaagattttgatttgataggtctagaagaaatgcacaggaatccgtattttaaaaatcatgaggcaattccgatttgtgtgattctggttctataagttgagaagcactgaatgtgtgtatgtgtgtatgtgtgtgtttaagtaatagtgtagttaatgctagtgttggttactaattatatgtcacttatcaaactacatctatttctgcatctttttatatatttattttagaagacaataacattataggttacagaaaaaactggatctccagaaatcacattatagattacagaaaaagaaaattggatctcaagaaatcatctagtttaatggagatcctaatgaaggcagatgtctaatctcactttttctcaaactaaataataccagctacttcaactcttcccttagggtattattttatatgtctataatgattttatcttttttttttctgagcactctccatattctttacctccttaaaaaataaggagagcaaagtaaatatattgataaatgttattaatgcagagtattacacaaaaataatttataggctttacataagtagccattatttatattatatgtattttaaatacagaggatattatttaatttccttaatgtattggagactttaaaatgaaaagtacatgtatcttgttcatttttatatgtctgacttacattggttatcttttgcttctcatatatttattttgctttatatctatatatctatttatcatctgtatctatctatcttctatctatctaattttggcgttttatcttaaagtttaaaaaaatctatggcactatatacacctatatgaccttgattctcctccagtggtttcctatttgtatgttgaggagctattatattttagacaagaagcttggcattttatataaatttcatatttcaaatagcaatttatattgcctattatatgacagatggagaaatgagattgatatgtaataacttacttgcccaatatcatttacctagtaaattgcattgtaatttaacatgttttcatgctcttttgtcttaaaaaaattaaagcttatgagaaaaatttttataatgaacatccttatatagataatttttatttcattatgaaatgaattttaaccagaattatgttgtctttgagtggaagtcaccataatggcagtctacaattatgtttattagtctcgtccattgaatcaaggtgcacatatttcccttctagaaggctactaataataattttctctcaatgcttttccactttgagcttaaggtgctcccgaataaattactacactaaatcctgccatcaaccaatgcaaaagaggaagcatttcaatgcatatataatttgtatccctacttgaaatgcagcattagatttctagtcacctcatattggattattcttatttttgggtaaaattcagtttatgtactaaagattccatcaccaaagtgaaaatagttgggcattatattacattatctgctaccttcctcagagcaggaatttttattttgcataaaaatgtcctttgtttttccctgagtattgaaatgttcatggtttagagtccaaatctctaaatgagatcactagcttgtatttactatgctaatttatcttttctcatagaacaataccgggttttctctgtgactgctgcttttcagtgacgtattgatctgattttggctaaacaatacaatattgctaaaatctggctaagaagaggaccatatcagataattcagtagaactgtatatcattttctattagagaatttatgttttccccttgaatagtctatttttcctaagtttggaccatattaaatatgcagatgtacaaagaacaactataagcaattacaacatactagatatgaaaaatgttttgataaaaagtctattaggaattatatctcctttctgcatctttcagaaattagttttttacttttcataagttttacttttcatagttttcttaagattacttaaagagaatatcttcttgtcattgtgaaatcgataaaatataaaagccatcttatatgcgtctgtttaaacctgctgaaacattataatgaaattgaaaatcaccatacattgtgtgcaataaaataatgcattattagttatattagcactcagatcattaagaaaataaaatgttctttatcaaattttcaagtcaaccttttgctctgaaatttatcactgcagaaaatatttaaatgggaagtctgaatttaatgcttttgtatctatctgttcttttcaggaatttgaggcattttgttagttttccattaaccacaaatatatatcttacatttcaccataagatatgaacataatttaggagacgaattagttcaaaacaatggaccatatttataggatcattaatgcaaataaaggagcagttgtacatttattccaaaattttatctgaaatttgggaggttttgtggtgatggtagatggattagggatgatactcttcctatacagatttcttgctctgcatggatgtatatttgtaggtgtgggtaggtgttgatgtctacttgacagtggagggtgggaggagaggagcagaaaagataactattgtgtattgggcttaatacctgggtgatgaagtaatctttacaacaaacccctgtgacatgagtttacctatgtaacgaaccttcacctgttgtttaaaaacatatttttgcattaaattcagacttcccatttaaatattttctgcagtgataaatttcagagcaaaaggttgacttgaaatttgataaagaacattttattttcttaatgatctgagtgctaatataactaataatgcattattttattgcacacaatgtatggtgattttcaatttcattataatgtttcagcaggtttaaacagacgcatataagatggcttttatattttatcgatttcacaatgacaagaagatattctctttaagtaatcttaagaaaactatgaaaagtaaaacttatgaaaagtaaaaaactaatttctgaaagatgcagaaaggagatataattcctaatagactttttatcaaaacatttttcatatctagtatattgtaattgcttatagttgttctttgtacatctgcatatttaatatggtccaaacttaggaaaaatagactattcaaggggaaaaacataaattctctaatagaaaatgatatacagttctactgaattatctgatatggtcctcttcttagccagattttagctcaatatcactgatcattaaggaaatgcaaatcaaaaccacaatgatactgtctcacacctgtcagaatggctactataaaaagtcaaaaaatagcagatgctgacaagattgcggagacaagggaactcttccctgtaataggcagcaccatcattaaatcatttctttagaaaacaaaaatgcatttttttcatgtttgtgatgtttgttggccatttgtatgtcttcttttgagaagtgtctgtttaagtcctctgcccactttttaatggggttgtttttctcttgtaaatttgtttaagttccatatagatgctggatattagacctttgtcggatgcatactttgcaaatattttctccaagtctgtaggttgtctgtttttatagtttggggttttacatttaagtctttaatccatcttgagttcatttttgtatatggtgtaatgaagggatccagctttaatcttctgcatatggctagccagttaccccagcaccatttattgaacagggagtcttttccctattccttgttcttgctagctttgtcaaagatcagctggtcataggtgtgcagccttatttctgagctctctattctgttccactgtaaaccactttttaaaaaataatgagccctttccatatattctaattgtgaatcttgatcataattatattatgcccagcttatgttttacaaagtgttaaaataagctctgcatgagttcattgtaaaaaaaaaaaaagtgcagatttgtatttaccccatgcatatctttgtacactttctgctcattactacgatcctacccagtctccacaaacacacacagatgtggctttgatattaagttttacatttgcttatatatgtatattctttaaaaaacacaggaatgtatatatatatctgagaattgctatttcaaaaatatatgtattactgaaaatttcagtgctagtaatacatattgtcacttttttactggctctatagttgcagttatataaatctattatattttactttaatatgttcctatagatggacatcattatgcccaaatgataattttaaaaatttagttttatgggctgggcatggtggctcacgcctgtaatcccagcgctttgggtggctgaagtgggcagatcacgaggtcaggacttcgagaccagtctggccaacatggcgaaaccccatctctatgaaaagtataaaaaattagccaggcgtggtggggggtgcctgtaatcctggctacttgggaggttgaggcaagagaatcacttgaacctgggatgcagaggttgcagtgagccgagaccatggcaccgcactccagcctgggcgacagagggagagtctgcctcaaaaatatatatatattagttttatgatcatctattaatacaattagttatcatcaccaatgatttacgtatttatgatacttttacagttggtcttctatgtttacagacaccgtatccataatttagctctgaaagatgattaatgccagaaactgtagagcaattaacacacctgaaacattttatcacaagtagaaaaaaaagactgattgcctatcagacaatattgaaaaattgatatttttattactataactgtttgaatgttttacaatgaaaaaatttcattattttgatcatgctactctgttttacttaagcattttagtattttaaagaggtaggattgtaatccctgaccctgttttttgtttttcgttttgttttgttttgtttttttaacttcaacttttgttttaaagtcacaagacacttaccggtttgttacatagatatattgcgtaaagctgaggtttgggttacaattgattgcatcacccaggtagtgagcataatgcctaatagttgttcagcccttgccctcttcctctctcctgcctcaagtagtccccagtgtctgttgttcccatctttatgctcctgtgtgctcattgtttaactcccacttattagtgagaatgtgtagtatttggtttcctgttcctgaattttgcttagggtaatagtctccagttgaatccatgttgctgcaaaggatatggtttcattcttttttatgactacatagtattcttccatggtgtatatataccatattttctttatccagtccaccactgatgggcaccgaggttgattccatgtttttgttattgtgaattgtgctgtaatgaacataggagtacatgtgtctttctggtagaatggcttattttgggggaggggtatatatccagtaatgagattgctgggtccaaggaactctattttgagttacttgagagatctccataacgatggctaaattaatttacattcccaccaacagtagataagcattcccttttctttgcagccttatcaacgtctgttattttttgactttttaataattgccattctgactagcatgagttagtgtttcattgtggttttaatttacatttctctgatgattagtgatgatgagcatttttttcatgtttgtgatgtttgttggccatttgtatgtcttcttttgagaagtgtcttttcatgccctttgcccactttttgatgggttcttgttttgtttaagttccttgtagattctggatattagacatatgccacttgcatagttggggaatatttactgccattctgtaagttacctgtttactcagttgatagtttcttttgctgtgcagaagtttttgaatttaattaagtctcacttgtcgatttttatttttgttgcaattccatttgaagacagtcataaattctttcccagggccaatgttcagaaaagtgtttcctagcttttcttctaggatttttataatttgaggtctgacatttacatctttcatccttcttcagttaatttttgtatattgtgagagataggggtctagtttcattcttctacatgtggctagccaggtaacccagcatcacttattgaacaaggagtcctttaacaaaattggaaaataaaattatattgacaataagttatttcataatacatttttgaattaggagtaattttagaaatttacgtgaagacagtagatatctataatttttatagaacacatcataataacaccttcacataagtccaaaggtactcttcagaaataatgactatatttctctgaactatttttagtattagctcttcaattttaactttgaattttaaaattatttgtatgtatgatattaagtaaagtgttcaaacaattttttaatgaataaatctcctgtaagtatttgtttgcaggtttttacatagacaggagtttgcatatcaattgagtacatgcctaggagcatgagagctggtattgcatggtaagaccatgttcagctttgtaaattgccaaaatgtcttccaaagtggctgtaccatttgccttctcactatccatgaatgagagttcttgttgctccacatttttaccagtaattgatattgtcaggttggattttagtcattctaataggagtttggtagatttctgtgcagttttaccacataggatgtttaagcattttattgtttagttgctttttttcccaaaattttattaatggaaccacgttttatggtgacattttgcttaaaaatgttttgctgagttattggtggatacatataactgcatgttcttaattttcagttctgtatattatcccactgtataaaatgtaacacaatttattcattttattataaataacatttgagttgattccaatttttcacttattcataacacatttatagtatttatcatacaaatcatgcatatgttagatttattcctagataacagtgatcttctgtggtcactgtaaatagtgccttgtttaacttttttcagttctcatcaactgacatacgtatttatctgttttgttttgttttgttttgttttatcctcctcaatagaatataggctttttgaaaacagcgttaattgtttgtgttgtttactgatatacccctaccacacacaacagtgcatgacatgtaagagaccctcaataaatatttaagttaatgaatgatatagaaacataattgagttttccatgttatccttatatattatgaccttgataatgatcgttaattctatccttatgcactgattgtagatacatctatttttgctttaagtgtgttgagactatatttgtagggtatacacttttggtattgctctctctttctagtgaatggaaattttaatcactatgtatttatttctaacaaatattttaattaaagtctattttgtccaataataatagctatatccatttttattttgtttgccttttatataattttctaccctattattcaaaccttacatgtccttatgcattatatgtctattagactatcatgtaattcactgtaatccaatctgataatctctttaacttgaagtatttattgcctttacctcgtttgaattataaatttgagaacaattctattattttattttttacattatatttgtcctgacttttctaagtagattttttttttttaacttttagcctttctttggctagttgaggctttaattcccctttttattttatttctttctctctactagtctttgttttgttttgttttgttttttgaattttgatgtttcttttttttatactttaatttctagggtacatgtgcacaacgtgcaggtttgttacatatgtatacatgtgccatgttggtgtgcttcacccattaactcatcatttacattaggtatatgctatccctcccctaccccacgacaggccctggtgtgtgatgttccccttcctgtgtccaagtgttctcattgttcaattcccacaaatcattttctgttttcagtgtttaccccaaatattttcatgtgcaaatttaacatataaaagcctaaagttatacaatatttttaccatctttcttctaaaccaaagatccttagcatgtgttacctccagccaccctactgttaacataaatgcctttactgtccagaaatatatttaaatatattaattttgatgctacaaattagatattgttgtttaatacagtaagtgtgtatttagatctacatttattttctaatttgtatgatctctgttatttccagcatcataggccttccttctcagatatttttctttattcttgaagtatagaagttatgtggtgctttagggagtatttgttttttgggtttgtttatgaagggtttgtgtctatctgtagatatcttaatttccactctaacttgtagaaaatagtttttttggggagtatctttctagctttataaacaagttttttccttctctcctatgtctctggcttccattattcttgaaaagtcattgtcattttaagtgtcagttttttgtatagagtatcttttctctttgacttcttctgtaagttctatagtttcactaccatttgcctcattgcagacttctaaaaaaatgtatccttgttgttctttgagattcctaaaaaggcaaattcacatcattaatcaattctggaaaagtcctagccattactttctttcaatatcaacttctccctctcatctccctccaaaatgttttttctttctcctgtttttgttaaactttgtacctttcatctcctggtcacttcgttcctggaaacacacattagtgggaacactaatttgggatcaattaaaagacaatttcagatttgaaatttcagatttcagttcaggtattttgaattatattggtattgttagttataactctaaacttgtttaaatgttgaattatggtcagaagttcttagaggaaactttttgattcttctcccattgtcttcctatcagagtaattttttaaacttagtttatttgcagagtgtgttgccttttgtgggggcttgtatggggttttaatgtgggttttaaatttaacctatttgctgaggttccagattttgcttcttatccctcaagcactttggtcattatatcctaaatctaggtcaacagctatcaaaagatacctccagggtaaatgccactttcagcatttgatatggtaagcacatatggattactattttattatagtttctgacctccaaggaatatagttgctttctcaccacctaagcaagtatttaaaaaggcatttcaaaaatatgtcatctaccatttttgggacatacttatctgaacatctatcatccgtattgctttattacacagatttaaaattttattattgaaatatgaacccattatttatataaaccctttaaaattattttaaaaatattgatgtatgtatttaataaatacataccctgcctgtctcctttaagatttcaaaaaaatactatatataaactatagcattatcaaagtatggataaaatatcaaaaaccatacagtagaaagtaaattatactaaagcttatgcaaataatacttattaaaatagagtgttgaacttaatagatttgacttaaaagtgtggctgccaaaggtaataggcataaggaaacttaataaggaaaaacactcagataccaacacttcccagcatttagcttgaaaagctgtgtgtcacaatgtgaagcgacattttgaaagatataatagacaatagcttccaataactttataaaacagaggaaacagtaattacatggctatttttaacttttattctcaatgtccatcagataatttgaaattaacattcattggggacattattacaagttaacttaatgtggaaaaaggatgaagcattctgatgattttctttaaaataaggaaacatcatggaaaattagataaatttattattagcatgtatctgaaataaataataccacccagtctattctccaaaatattaagatatatgtatttaataaatacataccctgcttgtctcctttaagttttcaaaaatactgtatataaactatagcattatcaaagtatggataaaacactctttataagtgttggaaaatagttaattttagattaaacattacagtgaatttctcagttgtgggcttcaatgagttaaattttaaaactatgcaatcccttttttttttttgagatggagtttcactcttgttgcccaggctggagtgcaatggcgcaatctcagcttattgcaacctctgcctcccgggttgaagtgattttcctgcctcagcctcccaagtagctgggatacagatatgcaccaccatgcccaactaactttgtatttttagtagagatggggtttcaccatgttggtcaggctggtcttaaactcctgaccttaagtgatccacccacgtcagcctcccaaagtgctgggattacagatgtgagccaccgcccctggcccaatcatacgctattaatagcatattttagattgaaaatcctaagaaaaaccatcagataacaattttatttatcaaagaatggaggcaaccaagatatccttcattaggtaaatggataaacaaactttggtaaatccatatgataaaatactattcaatgataaaaagaaatgagctgtgaagcctcaaaaagacatgaaggaaacttaaatgctattgctacaggaaggaagccagtctaaataggctatatactgcattattttgatgatataatattctagaaaagatgcaattatgaagataaaaatagatcagaggtttggggaggggggtggttaaatatatgaaacactggggattttttagggtagttaaactatcctgtataatattgagctggaggatacttgaccctatgcatttttaaaaacttctagaactctataacacaaatggtgaacattaatgtatacactttaagaagtcagggtatacctaataaagtgcaaaatgacaaaaactattaaaatgtataaaacaatctcactgatgggggtatagatttttttattttgttttgcttttctttttaaactgacctaagtaattttggaaatgaagggagattgtcaagagtaaagccaaaagaaactgtatataactactaggttctagttgacaatgttggttctcacattagaaatttaacaattatgaaatcactatacttgtacatggaagtggaacaaataagtaaatgggtggcagatggtagaagcgaagcttctcactgttaaagtgggaagttacatataagcaaggaggaaggctagaataaaccttgccatactggattagagttggatggatcaatatgacttcatgtttagcttaattagatactgatagatatacctagcaatatttataggtatgtgctagtatgcatgtgagttagtgttcatgcatgtatttcctaacactgtcccttcagagggcctagaagcgatgataccccattagcaatgagcacatccagcaccaagatcttggtttctaataccatcctccaacgaaagaaaccagcactccttagtgaaatgcatggttatgggactaggacagggtatacacaagatgagactatcctgtcttgtcttgtggtaccagaaagtaaggatgtgctcagtaaagaaaactatgaaggtttgtccaaaggacacggaagacaactgaaagagctccgaatattcaaagctggaacaagttgtgcaacagaataaactgtattggattataaccaaaagtgtaaaataaatatctatgagtttgtacttatataaatacattattgaataattaaacaggtgggggaaatagacaagttttcatgcagaagaacaccaaataaattatgtagacactgttccatcaagatgttggattataactccttactgcttatgtgcagactacacactttgatttaatttcaaagagtagagtaatggactgggggagagatagtaattgtacgttggagaaatctgacaagcactaccttaggcaggtgattagtgataagtcatgttacctttaatatgatgtgctgagaatgattatctctctggtttttgtctccaaaatccactaccctagtgtaaccatgtgaaaaacttctgaagaaatccaaatgaagcatagagtttagttcatggtaatttatcaagatggattcattagctgtttcaaatatatcatactaatataagatgccagtaatatggaaaaatgggtgagaagtacaaaggaactcattgtactgcctctggaactgttttgtgaatgtaaactattctaaaatggaaggctcatttgcatagaaaataaaaggaataatgaaactaaaatttgggatattgattacttctggcaggggagggaaagaaataaggcacatggaggcttcaaaaagattatcaatagttcataaagtgggtgatgtttacatttttattttttatttttatattcatgtatacttcatgtatgattttgtatgttgatatgccaattatttataaagtaacagtcgcctaaagaatacgtgatacagaaatggaagaaattctaagagataagtttatcagagaggtttctctgggaggtaatacttaatcatttggccaaataaataattggaatgctaaagctataattgatttggaattgaagatggagtatgacattgcaattatgtgttatgcccagtgcctttgtaagaggaaagatagaaaggttgtctttcagaagtgagaaatttatttggcagggcatttgaaagggtatgctttgagaattatgcatgttaatttttctcataaaagtgaataataatgctcatagtgataataatagctataattcatgcctattatgagttaatcacaagttgactgccttccaattcttctcaaaggctgtgcatggataattgataatcaagagagatgttcgataaacttattgcctgttgttgatattattactcttactgtacataaactgcgatagactgactgatgccaccactaaagatatccatgcattaacccccagaacctgtgcatgtgttaccttacgtagcataaggaactttgcagagaggcttaagttaaggatcttaaaatggggagatcatcctggattatctaagtaggcccaaataatcaaatgggttcttgtaagagggatgcagagggaatgggaaaagatgtcacagatgtctttggcaaaagatgtcacagtggaaccagaggttgaagtaatacgccttaaagaccatggaaggggctcaaatgcaggcatgtgggtggcttctacaggctggaaaagacaaggtaacaaattctctcctaaagtctccagaaggaatgcagtcttgctgacaccttaattttggacttctgaattccagaaatgtaggggattaaatatgtgctgtttcataccactaactggtaatttgttaccctacaataggaaactaatacattatgtcatgaaacctcaccagaactctatagattggaactcggattcctcaatttacagataaagaatcagagtctcagctaaattaaggaatgtatttgtattcagcttctcttctctgttgagtggcaaagctgagatttaaatcaaagtctctcttcctctgaagcctataccctttcagctctaatactgccagattagtgcagtggtcctggagttaagctgtctctattggaatcctactttactacttgctgggtgaagttagttaacagcttgggggaagaatagtacttttttttttttttgcgtcagattcatgataaaatgaataacagtacttaacctgcattattgtcaaaacaatctaagtatttagcagcataccttcatatctactgaaatagcctgaaggtcttttaaaccagaaatgtccaaaattgaatttattatccaaactctcaagctaccccacctccttcctatattacttctccatctttttttttttttttttttttttttttttttgagatagagtctcactctgtagcccaggctctagtgcaatggcgggatctcggctcactgcaagctccgcctcccgggttcacgccattctcctgcctcagcctcccgagtagctggaactacaggcgcccgccaccacgcccagctaattttttgtatttttagtagagacggggtttcaccctgttcgcaaggatggtctcgatctcctgaccttgtgatccacccgcctcggcctcccaacgtgctgggattacaggcgtgagccacagcgcccggccagttctccattcttatggcttcatcatcttacattctctgcatctcgtcttctcttctgacctcctactagatactttgttatccatgacgcccccttctgctgcacacacatgctagaaatctaattgttcacatgtgaaattcttcacttggaatccaaatatagttatcatgtctcatttatatggtcacacctctcccccgcttctctctcccacagtctagaggaccctcccgctgttattaacagtattttcaacatctcagtctttaccttccccttgatattgtcgaagataattttcttcaagaggattcaatttacttttgctttcaaatgctagatgcctcactgccctttatgttggtgctgaagagaggcctggtgcttgtttgctctgcagtgatgctattactggtttagtcccaacacaggtcacacgtgcctctgggctcctgcttcagggtgatagcttcactggttcacatcatcatgctcagccattgtttcctagaactgcacacaaaagacagagcggtgggtcctgaatggtcacagtcttaacccttgtctcttctagagccaatcagagccaacccttaagttccagttctgagtctaagaaacaatgcaggtacacatccccatccccaatttttggtgagttccattttagagccctttcctttctttagattccattctggtccacagtgccagagcttctgatatttgatcagtgtaaaatagatcaacacttcattcctaagatgttcaaggttgtattcagagaaattccgcattctttatatatgatatcttcaacaattttttttcttacacttcttatgcacaccaagagatattcaagaagagtagctaaaataagccaaataaatgatcctatcaaaactttctggggacggtggttacctagtcaccttatacaaaatcccataaaaaaaatctgctctaaggttacatacatttccaaatatggacaataaataggtgacaaggtttctaaaactgagccttattaggcattctgtttcaccttgtcactgtatcacccagctctgatctctttcttcactgtcatattcttcattcaagtttgcctcacctctcacttaagaattgcctcagctcctagccaatcatcttgcctccagactctccctttttttgtctacccactactttaacagttctcgaaacaaacataatggattatttgcttttttgtttaaaagcccttttttacttctcattacttctggaatcaattccaacttacttcaatttattcaagacaaggtcctctagaaaggggctacaacataactttctactgttagctcccaggaccatcatcctcagatacccatatctccttctatgtactaaaatccattttctccaaagtatgtatatagtaataaaaatctacttttaagacggaaaagaaggcaagtcctttctttctacattggtagtttacatattttatgagataattaacatatggatttcatatgtaggttaaaatgcgttcaggatgaaacactgagttttacttgacaaaaggtattgtgaattggtgtttctcaaaattcaaattttatgaatagtacagtgaaacagtaaacatgttctaaggctgtgtttaacattgaaggttgagagttctaatttattttgagattacgaaaaagatgtatatttaaaatacttattttagaacaagattggctggcatactttatgtatacagatttagaattttgtaaattcatatgatacagcaataagattgtgaatgaacaaagatgttagttcagtgcacatttttctttagattgttttatttgattctaggatttttaaaaattggcaatcgttacacatgatgaactattcagaccccttaaaaacatatttaaatggaatgaataaaactatggatattgcattcctattagattttacttgctttaaaaaagcatgtagaacaaaatatattcaaagatttacataagccagaaacttaagaaatagtttgagattaaagactatttcaaatagacagtatttttccatttgatctattaaattttcaacaataaatttcaattaaatttggtcattccaaaaacattggtcaagcatctagtatgtgtcaggcactgtgatcaatattggggaaaagagaaaaaaaaatctctttattattgaggagtatgcagtatactcccatgtgggtttagacagatatttgaacaaatattcataatataaactaataattcctataatagaatgatataaaaagtatttatgcaatctcttttgtactttagatggccatcatatttttgtttctttcctattaagttaatggaaataaattacaatgcaaagaagattagttgtgttattgaattgacccacggaaaaaaaaacattatacagaattgctctgcttgttgcttatgttcaaggcaaacaaaggtaaaatattatatttaaaatagccgtagtacatacagaattctcaaaaagtaatttaatgataaatacttctagaagtagtgacctcctattttcaatatagcatttatatactctattttaatttgctttttcaagttattagtggctttttcagccattatccagactaattttggtacataaaaggtataatcacagtgaaaattgacttttttattcaacagaaaaaaagtgttgtgagctattttccgtataattcattaaaattataacttaacagttttcccttttcaatattctttcaaagttagcatttcagtctaaaataaaagtgagcatgtaggacattaattgtacttgtctgaaatgtagttatctaaactaaaggctttaaaagaattattttccattccatatattaaaaattcatcttctcaactcatttaattactgagaattttcaaggacttttaaattatgtttccataaaattcaccacatcttaggatgagtgtttatttcttattccatgaaacgtccattatcagcataaaccaagcttgcaaattagaaatagtaaaaacaactttactatttgcattccattatccttgtacatggttttaggcttaactagagaaggtatctgcagttctcttgataattttttttctctgccatcactcatctagatatttatgtgatcttaaagtggttatattagagagagaaagagagagagagagaaagagagaaaaaaaagagtactggttttggttagatttgatccaaagacaaatttttagaaaatgaagctagaagctaggggtcttgaataaattggcctcacgatacatagttaagctgaaaagatttagaatttgaattcacatataatatttactattgttggaataattataatgagcacttagagatatgttttcttttgataagctttgtccatgtatcccaattaatgctggcttggtatgatactaaaacctaaaataacttattttgagcctatgtccttattacaattctagaggaagcctcttataaaatgtgattagaacacagtcatcaaagcaggggatcatttaaaaaatgatacatgcaaaacttagatattctaactttagtcataattgcatagatattacaacattcatcattcttttgatttagctctaaacccgatacactttctctttagtttgggggactcacaaagactttcttgactaagccacatacctcatacattgtatataaattttcattttgattttttagagtgggatacatgactattagaatcaattttaagatacaatcctaagtttttattatttcccaaaacatttcatagttgtcttatgcatatctgtttttccagcagcgcatctctatagagacttcccaaagcattcaaattaataccctagagctattacttccatttctcgttctagtacatttgctcactttacaaataaattatttaagcacaataaaagaaaaattggtaatttatttggggaaacagaggctactgattctggatgcccaaaactcactttggagtaagtgagcatcagtgagtatataacattttttctttcctgaataaatacattaaaaagaggcatttttatgttaagcaaaagttaatgtgttgagtccattaaagagataatgattaatttttttcaggagcttagattttaaaatatatgtttataagagaaaatgtaatttcctaactctttctactttaaatataatcaattctgaaagtaaatatatttaaatacactatgttataaatgaaagtttatttaaatgcataaaactgtgcctacattattttaaaatatggatacgtatctatttttgagattcagtaaaaataagaaacaaatgcagtaaattccaagatggcatttgctatttttcagcacaaataaaactatgcaaattttctgtttcaaacgtaaaatgccagtttttgattttatttatgttattattttttaaaatttcaacttttattttacatatgggagtacgtgtgcaggtttgttacatggatatattgcatgatgctgaggtttaaggtatggatcctgtcaaacaagtaataagcatagtacccaatagatagtttttcaacccatcacccttcccccttcctcccccctctaatagtctccagtgttaattgattccatctttacgtccacatgtgctcaatgttgctcccacttacaactgagaaaatgtggtagttgcttttctgttcctgcattaattgtcttaggggattatggcctccagttccaaccatattgctgcaaaggacatatggtttcattctttttaatggctgtatagtattcttccatagtgtatctgtaccacgttttctttatccagtccaccattgatgggcacctagcttgattccatatctttgtgattgtgaatagaactgtgatgaatatgcacatgcatgtgtctttttggtgtaacaatttattttcctttgggtatatacccagtactgggattgctgtgttgaatcgtagttctgttggaagttatttgagaaatctccaaaactgcttttcacagtggctgaactgctttacattcccatcaacagtgtaaaatcattcccttttctccatagcctcgccagcatctgttattttttgactttttattaatagccattctgagtagtgtgagatggtatctcattgttattttgatttgcacttccctgatgattagtgacgatgacaattttttcatgtctgttggccacttgcatgtcttcttttgagaagtatccgtccatgcccttcgcccttttttaatgagttatttggttttttgtttgttgctttaagctccttatggactctggatattagaccttgttgatgcatagtttgtgaatattttctgccattctgtaggttttctgtttactctgctgatagtttctattgttgtgcagaagctcagaaaaagagcttaactaggtcccacttgtcaatatttggttttgttgcaattgcttttggggcttagccaaaaattctttgccatggctgatgtcaagatgggtatttcttagcttttcttctaggattcttatagtttgaggtcttatatttaaatctttaatccatcttgacttaatttttgtatgtggtaaaagatagggctccagtttcattcttctgcatttggctagtcaggtatcccaacaacatttattcaacagggagtcctttccccattgctaatttttgtcagccttgtcaaagatcagatagttttaggtgtgtggacttatttctgagttttatattctgttccactggtctatgtgttcatttttgtaacagtgccatgctgttttggttcctgtagccttatagcatagtttgaagttggagagtgtgatgcttccagcttttaatactattgcttaggattgctttggctattcaggccttttttggttccacatgaattaaaaaattttttttctaattctgtgaaaaattacattgatagcttgatagaaatggcattgaatctgtaaattgctttgggtagtatggcaattttaattatattgattcttccaatccatgagcatggaatattttttatttatttgtgtcatctctgatttctttcagcagtcttttgtagtccctttgtagagaattttcatctctttggttagctgtatttcaaggtattttattttactttttgctattgtaaatgggattgtgttcttaatttaactctcagcctggatattattggtacgtagaaatgctactgatttttatacgttgattttgtatcctggaacattacaaaagatgtgtatcagttctaggagtcttttgcgagtttttagggttttccatgtatagaattattttatcagtgaaaagagatagtttgacgtcttcttttcctatttggatgccttttatttctttctcttaacttactgctctggcaaggacttgcagtcctatgttgaataggagtggtgagagtaggcatccttgtcttgttccagttctcaagggaaatgtttccaacttttgcctgtttagtataatgttagcttttggtatgttgtatatggctcttgttattttgagtcatcttcctttgacacctagcctgttaagggtttttatcatgaagggatgttggattttatcaaatgcttttcctgtgtctattgagataatcataaggtttttgcttttaatcctgtgtatgtgctgaatcacagttatttatttgcatatgtagaaccaaccttgcatcccagaggtaaagcctacttgattgtggcgaattaactttttgatgtgctgttgaatacagtatgctagttttttgttttttgttttttttttagatggagtctcactctgtcacccaggctggagtgcagtaacacgatctcagctcactgtaacctcggcctccctggttcaggcaattctcctgcctcaacctcccaaatgtctgagattacaggcatctgccaccatccctggctaattttttctatttttagtagagatggggtttcaccatgttggccaggctagccttgaactgctgacctcaggtgatctctccgccttgacctcccaagtgctgggcttacaggcaggagccaccacacctggccatagtttgctagttttttgataagtatttttgcatctatgttcatcagggatgttggcctaaagttttcattttttggtgtgtctctgccagattttggtattggatgctggcttcatagaatgagttagggataagctccttctccctgacaatttgaaatagtttcagtgggactcgtagcagttcctctttgtaaatctagtagaattcagctgttaatccatttgggttgaggcttttttttttttttttggggttgatagtttttttttttaattactgattcaatttcagaattcagtattggtctattcagggtttcaatttcttcctgattaaatctggaagattgtgtgtttccaggaatttatccattttctctagattttctgatttgttgcatatagaattgtttgtagtagtctgaagatcttttgtatttctgtagaatgggttgtaatatttgtcatttctgattgtacttatttggatcttttttttctttgtttctctagctcacagtctatcaaccgtttttgttcttttgaagaactgttgatttcactgatgttttgtgtgaatttttacatctcaattttgttcagttattctccacttttagttatttcttatcctgggattggtttgttcttttcttctagttcctttaggtgcaaagttcagttgttaacttgagatctttctaacttcttgatgaaggcagttagcactaaaaattccctgttagcactgcccagagattttggtaagttgtgtccctattttcattaatttcaaagaatttttaaatttctgccttaattgtaatgttcacccaggagttattcaggagcaagttgtttaatttccatgtgtttatgtagttttgggagatcttcttgattttgctttctatttttgtattatggtctgagggtaggcttggtatgaattatattctgttgaatttattgagatttggtttattaccaagcatgtggtcaatcttaggatatgttccatgtgcagatgaaaataatgtatattctggttgttgggtggagtgttctataggtgtctactagttctaattggtcaggtgttgagtttaagtctagagtttctttgctagttttctgcctcaacaatgtatataatgctgttaatggtgtgttaaagtttcccactattattgtatagctgtttaagtcttttcataggtcaagaagaattcattttataaatctgagtgctctgatgttgggttcatttatatttaggataattaattcttcttgttgaattgtaccctttgtcattatataatggctttctttgtccttcttaattgttataggcttacagtctgttttatctgatataagaatagtgactcttggtcttttttgttttccatttgcatgatagatatttaacttcatgtccactacaaatttggttttacccatatatttcatatttttactattagctgtctttttataaataattgcctccttaatgcagttttaaacataataattgtttagagaagcctgtgggtgttgttatgtgtgagataggtccctcgaagatagcacaaggttgagtcttgtctttttatccagttcttcactctatgttttttaactggtgtgttttgcccatttaaattcagagttaatattaatatgtgacttgtttatgtcatcatcttgttagctgattgttatgtagacttgattttgtagatgtgtgattttaaaagtcatttagtttttgtataattaaatacatgactgcttctactgctactaaggagaacaacagaagctaacattgctatagcatttaaactaatttaaatctaatttaaactaatttaatcccttatgataattttatgagtgaggtactattactatgaccattttgtagatgatgaaactgaagcacggactaactaagtagcccaaagtttggggcctttaactttgtaagtggtagaggcaacatttaaaatgagggagcatggcttcatcatgttctaagccattaccacatttttacaaaatatggaagcaaattccatgtgtttgaattttaacttccaattgtcttctaccaaacttgtatttactaaaaagattaattttaatcacctactaaataaatccatgctagccgacttaattcattcagtcagaaaaatcaggttgtttagtaagagagctggtttaactttaattttttaaaactgtattgactatttgactaaattggctgggactacatgcaaaaacaactttgttatgaattagaagcttgggaacaagcattcttgctgagattccttagttagtcagttaatcaataacatttaccaaatgcactctgaggggttgggaaggtgaaaaagatatattagacatgtagtctcagacgataaagtaattacaatctagtaggaaacttatattcttgatctctaaacatttgaatttgatggttgattggtgatattattctgagatctttaagatacattacacagatcatatttttaaataatttttttattttactttaagttttagggtatatgtgcatgctgaaacgtaatgtgtatatgtgttatactctggttgtttttctacttgtttgatcctgttttttttaatgaatgatagttactcccagaaaaataatgaacacctgtacatataatttgaaaaagtaacacatattgtaccttttctttcacagatgactaaaacaataaaattaaacttagacaagcacatcttttattatgaataaacgttgttgagaatgggtttcaaactgaccaaaaatacttctaccttcgtttacatattcatgcatcattttcaaagaatatttgcaagaacttgagagaatcttcccagtgtttttttaaaaaaattgaaccactttttcttttaatgctgacttagtaatactttcaaacacccccacccacatttgactttagagaagacgttttagaagaaggggaacattttttgctcactgcaagtgtcatctgactatttttaaagatttattcatcattcattcaaggtagcataatgtcatgagaatgccagctttgaaattagtaatctgtcatgtcttctactggccactcttgcagtttgattagatgcaagtttgcttctctttgaacatttcagtttattttttctaagaaatgattatattgttcaagataaagtataaaattatgtagctatcaggagtatttattgagatatataccactgcagatgtgagaaattaaaacatttttatggcaagtatcttgacctgaaaaagcttactacttactgaagatagatggaaaaaatcaatctttatttttaagaaattactattcaacctaattgatgagtaagcctatggcagatattggtgcatattaaatacaggtattctcagaagagttacagaaccccaaaccaaattgttccctccctatatggtcttcagttgtagtttttgctttccgttaggaagatgattataatttaaaacatgttcatcttatgaaaaactgtttttcctcatctgcatgagaagattaacaaaggtgaagaatactgtttctatgacacttgtaggtgcctatattccaattgctaattatttttcaatctgatggaaatgcgtaaggatgaaagagctgtgttgctagagtgtgtttcattttgcttcagtaagcactgaaaaggcagaagatggcagggtaggtctttaaataggtgatttaaaaaaaatcttcctctttgtttttcttctcctaaaattacagagcagacttcattttatttcctagtaaatattccactgccagagttagctcatgttttgttattaactcaagttgttcaccagtttgcttgttcaactttctctaattcaggagattttatgtcgcacaggcttggagttttcttgattgccttgttaatgctcttatttcctagcaatcaatttagtttgattgatatttgttatgcagcctagttagttccttcacttgaatttcatttacaggtttttttttttaacttacttccttagcaatcagtttgtcttgattgctatttacttcctgacttcttgatattgcaagactgcataaacgtcctaattacctttatgtccactgcaaatttagttttactcacatatttcatatttctgttattagctgccttttggtaaataatagcctctttaatgcagttttaatgcatttgttgtgaatatagacaatggtttgaatgtatatttgcttacttctaacttagaacataaaacatgtatatattatcatgagatacattataactattataaaaacaatcacattagatttaaaaacataaccagggcaaaaagtgaataggtacatacaggtaaactgtggagacagccttaggctcccttagaacacagcaagcttaacctgaacatcaggtttatctctcaccattgggaattaaaaaacacaaaataccaaacaaaaactaggtcactaataatgttctctgtttctgagagtaatttcagacagcactgataaactgaataatgtcttcagtatttccgagagcctgaagcaaacgtctcccaatttaaattgcttcaaggtgaagcagaaacttccttggaatgccatatttctaatagttccctaagaaaggtaattaagtgtctattagattagaaaaaactgctttgcttaattctatgaaccgttgtatttattttaataaatattttaaccatcaaataatcctacaatgtcttaaaaacatgaaaaattaattctctagagggccccattcagtggctggtaaatagtagatgctcattcaatgtagataaactgttcttggatctattttacaatttaagacactcaagctgtgaatctttgcatgttccttctccacatttaggtgagagaatgtttcatctgctctctaccttaagcagactgttgtataatcctgccttctgctcaatatttatggagactagatccaatgcaagcgtgattgaagaatcgtaagggaagatgttctgcaaaatgagagccatgtctctacatctagtaatgttatcagtagttgtaaaactcacaatattcttccagcaagcctttctgcatgccagagtatgcaggtgccataagagctaaaaagtttcaaatttaagagtaataaataattgtatcattgaagtaactttagaatagaggcgataggttaactggcatttgtattaggaaataagagggtggtcaaataatcagagaaaacttagagaatgtgatttgttgttttcaatcaggtcttgaagaagcttatgaatgatttggtattaaagaaaagaacagtgaaacaatgttaggataacagtttatctgaaggccgagaggttaaagtgggcacaagagcctaaaatacaggaatttatgtaagtgcgaaaggacatttgcagaaaggttcagaatcattccctaagtaggattttaccttaatcaacaataaaatgatgctttttttaatgacatttaaagctttgtagtgtatgaatgtttcttacatctcttgcctcttgaaagaaatatttttgcctacactctaccattcaaattctagtcattctctaaggcccagtacaaatgtatatatcattatataagtagttataatattatatcttatttatatgatttatatatatttatattattcttatgtatttatatttataccaacattatttttatataatttatatatttcttaaacttcttttcacctaatatattgtaaggctacaccaccagcacagagcgatatctctttctggatctctcagcaattaatcatttattctattgatgcaagcttttagttttgttgttatttttaattgaggaatactttacatacaaaataaaatgaagatcttaagtgttcagttctatgagttttataaattatacacagccatataactacatccacatcaagattagaacattttcatcactcagaaagttctgttttgcccttttctagttgatgtcccttttctgaattttgttgttataagattagtttttctggttatttatatttatggaattgcattatatatatgttatatgtgtatatctagtatcttttaagtgacatgtttttaaagttcatgcttatatttttaacttttttcctgtgtatttccaagtaatatctcatcctataaatatacagtaatttgcttatccattttcctgtcacacatttgtaatgctttgtaatgtttccaatgagaaaatggttggtgtgtgttaattgtataagcaaccacaaaaacaatcttccaaagtaattgtactattttgcactctcatcagaaatatatgagagttccttttgctccatatagtcatcaacaattgttgttgctagtctttcttactcattgtagtcttttgtaaactttctctacaaggctttaggctatttttaattggcttgcttgtcttttcattattgactgttaggagtttattatataatctggatataatctttcattagagaggtacaggaaatatattttttctaatctatggcatgcctattcattttcttaaattcttaggtttcttaacattgtttgttggtgagcaacattttttaatttagatgaagtataagttattaatttctttcttgtataattagtgtcattgctgacgctaagttcacaaatattttatgcattcttctgaaagctatatggttttgaatttcacattttgtctatgttcgtcttgggtaaacttttgtgtatagagtgagataaaggccaaagcatatttatctccaaagtttatgttttccatgaagctttgtgagtttttaaagcaaatatactaatccggctcttcatttttcttagtcaaattttcacataatagcctatcttctcaatacgtttgtaagtatattgagaaccaaaattattttttaatatttttccataactttacagtgtggattttactttgtttttaaaaagcaaattgtatttgaaacaatgattccaaatattgtgcgcattaatattgatttgtgattgattaaataaatcaaaaattctaataggagtgttacatggaacaactaaagaaaactagaaaaggaaagagtagtatttacaagatattttcttttagaagcaaccttttgcatttagattgttttcgatgttatcaaaacattagataaggtttttcgaaatgtcaacataggtagcttcctggtcaacaaagccagcattactcctttatttacacaaaagaagtgggttcacagactggcaaagagtgatatctagtgggattaccttaatgtcttgatggcatatattctcatttatttaattttcactttgctgtatgattcctaccagttaagacaggaatgtaatgtgctaattaaattattgaaatagttaagcatattatatatctttttatggagaaatcagatgtagtgtatttaggaaaccttattacttaaattcaaattcattacttctgcaagtttctctggagatagcacaacaagcagtatcttttatattctcaaggaggttagagtctgatgctttttcttcgagatggagttttgcttttgttgcccaagctggagtgcagtggtgcaatcttggcttactgcaacctctgcctcctgggttcaagtgattcttctgcctcaacctctggaggagctgggattacaggtgcctgtcaccaggcccggttaatttttttgttttttagtagatatggggtttcaccatcttggccaggctggtctcgaaatcctgacctcaggtgatccacccgcctcggcctcccaaagtgctgggattacaggcatgagccaccacgactggccagaatctggtgtatttttaagcatcatatgtactcttaaacagtgtgttgtcctctacatgacacaagtgtatatgcggatgaaataatttagctacctgtcaaaacggtaattatttctagcaaaaaatagcaaaagataacctgttttccaagaagcccaactttacttttgtgaatgcctgaggattgctaagaggcaataacattataagtattgctaaagtggcaggctgtaaatagagctgactgagcaaagttgccatgggaaacttgtagacttttccaaaaacggaaactgaaccaaaagcattgatagtagttgaagtctggggtctgagagaaagtccttctgcctcctattgaatgtgcctaccaggctgctagagaataggtgggtttgtggacatatgctctgcttatctatccctttgcaaattcccttatatcagttcaccttcaaactcagcacgtcaggtaatgaacactgagaaatgaaaaagaagtttggaaatggaaatgaatcttctcatggaaaatttgtcttgaatttagcccgtaaagggtaatctaaaatggcttacagagaggattttataggacttttttaagttgccgatagggtccatgtttggcgtgctctctcctgctccttcatttgttttttctttcacgattgcccctgctaatactctccctctagttacaaaatgaaaaacatgtgacttgaagagggtttctttcctgaggacaaatgagcaacacttgaagtggaataccaattttttgaccctagccagcagtgcctgatcattccctcgcgtattttagcaactcccttgcctgctgaaccactaacatagtaaatagtagaatcctgctctcaaataatggccagaaaatgttcaattttggtttccttgcacaattcactaatacagtatatgtttcaataattatgttttacaattaagttatatcaaaactcctgacaataattgataaaaaaaatggaaacagtacattttggaaattaaatgtaggagctaattacttcaaaggacattgttgacagatttcattttaatgtagaaaggatatttattattttggtttataagtctttgttgagtttattaagcaatttgtgttgagaaagaaaatgtgaatctaaagatttagtagaacaaagtattaccttgttataataaaaatcctttaagttaaaatttaaggcgtttctaatttggaacctcatttctgagctgttcagatttaactgaatctatttttaaaaaacttaagtagaatatagcacattatctcttcccacccttttttaatgagtagtttttattgattgatgaaacaggagttgtgttagaaatattatgtgtatacttttaggtaactgagcaccattttgatatcaatcacattttaagagaaaataattgcttatctttaatgagagtttcttctattactgatttttattttaaaagtacaattttctgacaatagaaacatttttcagataacatgtacttatactatacactgcctgccaatagattttgcctttcctgattaataatgttggcttgtgaattctaaattccaaagggacatattttcacaaacagaatcagtgacatattaaaactatacggggttaactcataaaatgctctcacaaaatattaccaatagattctattccaacttaaacagaaacttaaaaataagttcacattatggacaaattaaatagatgaacttaatgattgaaatggccttatacttttataaatagatgaaaattaatggaaaaaaatatattaggtatgtattaatgaattaattttcaaaaacagagtttttgcttcataatgactacatatgtaaaagattttgtagaagttgtactctaagtgtaggttaatagacactaaattattttcaatagacagaacttagccacatgatcctgaaaacatattctaggaaaaatttaaatattgtgttatattggaaacagggaagaattggaagaatgggaacaaagttatttatttaatgttaagattcattactaaaaattaaatatttgctgacattatagttttatcataaaaataaggatagtgtaacaatatctatgatataatatatttaaaatcatgtatttaaacatgttgtgaaagaatttgttccctatactacaaaaggtttagttaagtcatattaatgaaaataattcaaatggctcctataatgtatattttgagtgaatacatttatgattataaatcaccttaaatttttcctgtaaagaaagcaaaatgtatctgtgggcttaaaaaaaatattgatcacttaaaatgaaaactcttgtgagaaattcttgagcaatgttggtttcaaaggctctttgacttcaggagaaagaatatagaaggctactgaatttacattttccattatttattttccaaattaattaatagaactagatcccaccttctttatatttgggttgtattgaatattggatgaacatatggagagctcagatttatgtaaactcacctaggaaatatgaatgaatgatgaccattaactctcaccaacacaaaattattttttaaataaaattatgattataaggtattttctgagattcttgtatattaaaatctggcataatggtattggtaatgaaaacaatgtctgaggttctaactgaccataattgcacactctattgtattgctagtgaaccgtttagcagattccattcatcttagaagccttagattgattaaaaaattaatgattgatgacaattaagacttagactctataaaataagatgtaaacatcatgggttgctgattatttcttttttgctatttagaaatgtagaagaatgcttatttaatatatacaagttagattatatcaaacttttctgtgccttttgtttctgtcatatggcattgaaatattgtacagtcctatagtaacactttaggatgttatattatgaaatggaatactgtatattttcaaagacatattgtaatataaatccccaatatctatctgaaatttaagaaaattgttttgagaggaatatcatttgtcttaaggttatatatgtacttaagagtgttaatagtactttgtttagtgtttttaatgaaagatggtgtgttgaaatatgcaggtctagaagctttaaaattagctgtaatataatgtgtttcaaaaaaattaatattgggctgggtgcggtggctcacgcctgtaatcctagcactttgggaggccgaagcaggtggatcacctgaagtcaggagtttgagaccagcctgaccaacatggtgaaactctgtctctactaaaaatacaaaaattagccggatgtggtggcaggtgtgtgtaatcccagctacttggaaggctgaggcaggagaattgctagaacccaggaggcggaggttgcagtgagccgagatcgcaccattgcactccagcctgggggacaggataagactctgtctcaaaaaaaaactaaaaataaaaataaaaataatattcaaatggtctgaaccatgttgaatgtaatagtgtcattgtttggttggaacatgttaaaatgttaagatttttgtcaaggctgcagttgtacatgttgaaactaatgaagaatatggtgattctacagaaaatacagttaaacatttctgtcatgaaccttctatagtcatgtacaatattttggtctggtacactattgactcaagtggaagtagtgattcaacagcttactcttttaagtatgtctttggaatcaggggactgagatgctattcttggaatagagaggcatccattatatggccctcatagcagtcaactattttctgagtaaaatagtgattataagacatttttctgggaattttgcaaattacatcaagattgccaggttaaatgtaagagctagggactaaattttgatgttataatacacaaaagagggatgggttgttcattgccacaatattctagtgacagtaaaccctgacacctctgtttccattctgttttagtagaagaaaaacgtgagcaaattgaaggaaatccagaaaagttttaaagatgagaattactcagaatacacagatagatcaggaaatgaataagacagttcaaaattagtcaatatctgaaagagaggaaagcactagttaaggaaagaaattaatgatttgaaatttatccagaaataataaaaataatatgagaaatatgtgggcattattattagcaaaaactaccttggtaatgaaacttgagtaataaaagagaataatctctcatggaaagataatgcaatttctcttcatttagagaatctgaaactcagcaagctaaaccttcagcagcagtgccaatgtggtaccaaaaggactagataaacagtgagccttagatctagtattcatggttcaataaatactttcaaataagtataatccgttggcatgtgctctttaagatatgcaatgcgttagaattattggcactatttgaattatatacactattgtgtttgtaattttttggttcagttaagttataattagggaactttagatctcttactgtcaagtcaaaattcaggagcattgccggctggttcaaggaacatctgttacattaaattttatgattttcgcatgagttattgctctatctgttgagagtgtcttgtttccctcgaatttaactttaattttaaacatttgtagaaaatgtttacatcacaataaagttgtacataagatttaaacactcataatggaaaatgaattgtgtgttgtcactcatgtctctacatagccaaaagtaatgtaaataatggtacaatttttgactgttatatagcagttttcagaatgcaacttagacttgttttacacatattggaaaaccaagatgaatttttatttcagttaaatactccctggcatcggtgtccaaggcctaagagtgggattggggggtgagggggacgatagattcttcctgattctataataaaatgactcagcagttccctgtgagcttggatgtatacacatatgtttgtgataaatcctctgactatatttcttacatacagagtgaggagcaattgaaacacatcaaaggaatatgtgtccttcatcagcaaaagacaagaaaaaaggatgatggacaattttcattttacttggggcatgaaaatcaagttacttaatttttttttatggaaggagtgtttatactgctcagttttcaaatctcaatcatatattttattatgtctggatatgttacatttcacattaaagctatatgtttagatataaccaaggaggcatcattataaaccatatttctagatgcctttcttccctacttggggtgtcttggatagagctgaagcttattcatgtaaaccattgatgatgccttaagccatacttactcacaaagaagtgtagtgaaaataaaacatcttaaaatatttgtgattgaattgatgggtaatatgaaactgattcattcattggaataaataggaaaagaagttttaatgattcatgagaaaatggaagttaggttcaattgttaaccagaaaaggatgttgtattctcaaataaaggcacgatgataaaggagcctatacattgagagggacagtctttttaaagcaagacactttaacatccatttggtctcttctagaggaagcactctctattaaaacaaagattagaatgattttaagcctatacatgtcaggagaatgagatattttttgacttgttattttggctaacaagtatattttcatttctgtgattcctcatttgcaaactgattaaagtggttttagtacagtgtttcctgtggtcacgtaggactgtcttaggctgactcagaatctatgatccaggcacattgttatcgtagcatttcttaaactgcaaaagtaacagatttccctactgtaataattctgattaacagcgtaagttctgagacaggcctgattctaaatgtcagtcatgacctcttatatcctaatcattacacagttcagtagagaagaaaagtagttgaatttgtactcagacatgtgttaagtacagaagccaccagaggtgaaggtctatccttcagagcagttcaaaagagaaaacatccaagagctctgagcctgcatattacgagggaggcttgacagatgtacaaagaggaactttggctaaatacaattcaggtacagtaaagtataacattacttctcatcactaaaatacaaccaccccatgtcctggaatttgatgcacaaggttaaaaaagcaaaacaaaacaaaactttaaaatgtagaactattttaaagaattatcataaatcagaactctccttcataaaggcctgataatttagagattatcatctatgcaattgtgttgttattcaaagtaaattaactcctggcttatagtacagtattaattttgcatgactggaatcacattagagaccatgttactcctagcaacattactactaacatttacttggtgattttatactaatttacctggatatccttatgagtaaaatgcattgtacaaatacatgtaaagtagaataaactcctatatttgtgaataatttcttccataatgtattagacaaatttcaaatttggatttagaaagcagcttattgaacaatctaattcattttctcttaaacttagtttatcatcaccatatcctgggtcattatcccgtattatattaaaaaaagagttccaggcttcattaccaacctactgaatctgaatctacttagcagaaggggtgtggcatggaatcaaagaggatggaatggaaaatactagaaaattgaaatttgaaataaatcactagattttgatgatttaaatatatagaacattatctagtaaaaaaactcattttatagatacagatattaattaattcatccatgcatatatttactcagcatttcaatgcaaatatgtaattaaaaataattaaaataaaaattagatatcatccctatcggcagagactttataacctaaagtcatgagttatgtaagtatttgcgtgcaacccatgtcaacagagaataaattatcaatgtattgttagtggtatggatagcaagagttgtgatatcatggaaaagatctgaactagatatcatgattgtagctcatgtaatttttctaaaaatcagtatccttgctgataaaacgaatgcactaatttagattatttccaagattctttttagcacaataatcttaaaattatgttatttcagagaagggtgagtgtgaggtggaaggatggtggaattgtgaaaaaataggacttgagactggtagatggataaagtaggagagcgagttgggagaatgcaaagttggtggaaggagaggagtgagttaagacaaaaaactggatggtgaagtatcaagttttactaataatttcaaacatataagcacttgagagacacaggtgaataggagggacctgggactccaaaaggagctcccgaggtccgtcctttcatcaaattcacatttttggcccagagtagtagaagaggttcctctgagaagtgagttacctcacccaaagggagtattttaaattataaaacatttctattgtatgtacaaataattacatagcttatgtgacatttatagggaaccatattccacaaatgtatagaccctagatttgtttcctagaagaaatccagaaatcctaaaccatggaccacctaataaaacatttatatacattaggattcttaattcatttgcttcccgtgagaatgattactagcatgtttactagagggtgagactaggttaacctgctttctttcattctcattagtgtccccagtaataggtagaaaaatagatcatagactagcttccaaagtctttctttcccagggaaaaatgtatatgtttaggaataaacatggtatagcaagatgtcaggatctaatttgaagataaatctctattttaattgtatcaacatttaaaaaattgattggggttaatttctactgatatataactagctgtgcctcactaaagaagaatttaaagtttgaaaatgtaaaatattgtaaaagaaaagagattttatttaaaattgattcttctaactttatttcagaatacatgcttagatggcactttgtgggaacagtcggtagggagaaagaaatgactcaagattatggcacaacttcaggatcaacagaatttgattctgttcagaattttcagattcagaattttctcaacctattagtcccattctgttactgtctatattttgttaaagttaatatgcaaagtaaagcatgagatgtgcatttgttactcattttatcgctattagcttttactactggaaaaagttatcagcagttttgctgggaactgtcatatttctgaatttgatgtaataatttaaaaatatgcctttttatgagatttcaactaaaagacatcctctgtccctttaaatttattttgtggtcaccagaactcacatatcgaactaaagtttacatttgaatttttacttttcacgaattagatttttactaaactgttgcattcttaaaattactttaatgaaagttgtctctataattcatatgtatagacatttatgtattaaaggatatttatgtactaaagctaattcttgtcaacccttatacaaaatgggacttattttaattgtaactaaaagctaattacagatacatatatatatatatatacacacacactttttctaattagcctcacagaaaaatttatcacatagtctgtagggaatgtgtaatgtgctatttaccaaagtgacagcaatcaatctattatgtaattttgattttcataatagtaatttatgaaattaattaaaaaggccaacatgagatgctgcatttaggcatttttttcaattatgacttcatttttttagtataatgatttcaatatatagcctttcaataaatcagacagatgcaagttattcctcttacatctctaaaattggaaaaatatatttgagtatcaatgaaggaaataaaactgtaattttaaattacatccaattctgctaattaagtaattattgaagacaaaataactcatagagaagccctatatattccatatttttccagtctctcctcatttaatattcttatttaattatgaggtatagaatattagaatttcattactggcatctggaagcaaagataagatggttgcaggctttctggtatggcattgtgtgtgacgtgagctgactcacagcataaagggaaatgagagagagtgagtgttccttactgaacttaattgtacataagagctcctctgtagcgttgctttgggggtatctgccatagaactctctgataatgatttctcatcagtggaccaagatgccattaagtcattctccttgttaaaatctgcttattgatgagtttcacttaaaaattaaattcaggtcacttctggacaattgtcttctaatttttttgttctctacataaatggaaaataagtctataatgtttgtcatccaattaaaattttatataatgaagactgtgtttatcaaagacaaagtaactgattcaacttgttcaaaatggaccattcattgaaatgttcaccctagttatatgatgctgtagagacaaaaatatggttgacaatgtttgccttctgaaatctctgaaatgatatgatttagtgcaaatgtctctcaaatgtgtttttcttttagttaaaagtaataatgattaattctgtcatctttctcatttttcctgaggtaataggtattatcaacttgatatacatcttattacaccttattctatgctaataaacatagaaatatgtatagacatatataaaatagaagtgactttaagtttattttacaaaaataaggtcatagtagataagtttgctttctgtttttaaggtaccatgatatccctacaggtcaatagaaataattaaaatattattttaagcagccacatagcatttcataaattgaatgtaatataatttgtgtgatcattctagtgataccaatttgtgttgtttttagatttgttttggctttgctgctataaatatgcttcaataaacacatttccaactggcacacctttttctccaggatagagttccgagaatggagtttctgggtcagaggatgtatgtgttttttaaaaatattactgtattaccttcataaatggctgtagtaatttacatccccaccagtcatatgtgagatttacaatttatgtatgttcttgccattctaaatgctgttaatgattttattttattttcatttttctttttgactaatctgattggttaaaaaatctatcatatctaattattatttatatttgcaattctttgtctgcatgataccttgagcatgtgtttttgctttctttgacatattaggtttccctgtgtctgattttcctgttcttatactttagtttatacttttcttatcaatgtatagatgttcttttatgagacattaatcatgtatctcaagtgtgtgacaaatatttttccctataagcctttgtggtaggggactagctacctctcctacatcatacctttacctctataccccctgcatttacttccagctactctgatttcctgacttaactgtcaaacaagacaagcctttgtattaagtcctcaacctgggaaagctcttccacaagaaatttacatggctcactcatttcattcaagactaaaataacactgttgtaactctctctcctcatttggtgttatttttactcatagaagtagtatttctcattactgtgtattatgtatctcctgtgtgctatcacttatgttatacaatctccatgacaacaggagtgtctattttgtttactttgtgcccccgcacacccaacatttaaaacactgcctagtacacagtaaatacatatttagatttgatgaataaataatttgttttttgtttttattgatgatatcccaatttttaaaaatctaaaaatcactgaaatctctcaaataacttgtattaaaacttctggcctaggactgcattatgtctgtacttttagttagggcatttccctttccaaatctttgtttgtagtaatataggcactactcagtattctcaaatacctatcagtggactcttcattatttactagtccttagtctcacattgtaaagtttttagcaataattagatcttagagctgagcataattaccccactcactgtcctctgaggccatcaccatttacacatctcttactcttaacacttacacactccaatctcaggccctgtgccactgccgaggcgactgctgcttcctacctgttgtaggcagaatcttgttcccccaaattcatatgtcaaagacctaaccccagtacttcaaaaagtaaccattttgaagataagatctctaaataggcgactacattaacatgaggccattagggtgggttctaatttaacctgattagtgtacttataaaaatagaaaatttgggtttacagaaagggacactaaagatgcatgtgtgcggtggaaagaccacatgaggacacagagaaagtggtcatctgcaagccatggagagaggccttgggagaagataaacctgttgacagcttgaatatgaagaatactaggatattaaaaagtcgatgataatagaaaagagaaaaaagtcattgctgatgcccttctccaagaagctgaggaattctatctagctgcagcagccggctttgtaggagcaggtgtgccattaaacacggagagtagaaaggatggtgcaggttagctaaaaacagtccagtgtcaatggcaaagattctgatctagcaggcaaaggagagcatggcagaagaggaagctctgaaagtaggaaagtctaaaattagagacagtgacaaagttatgatgctaggtgatcttcagaattgtgacatgcttcctatgcaggagaataaagtagaaggcttggggaagaaaatctagccaggatgttgggagacctgcccatagactggagtcaggtactagaaagaaatggattttctaggtcaaaaatgtaaaacagaaatcttgttctagaccaagtcatcaaggaaggcagcagattggaaatactgtgactatggaaatatgtgacaatttagaattcattactgcattctggatgttaagctgaagcatctgataaaccttttaatgcaggcacatcttacggaaaaaggtagaattcatctgtgattttagtcacgaagatctgggaaatcctaggcagacatgtttaattctgttctgttcttttatttaaaatcaaaggaggccgggtgtggtggctcatgcctgtaatcctagcactttgggaggctgaggcaggcggatcacttgaggtcaggagttcaagagcagcctggtcaacatggcgaaaccccatgtctattaaaaatacaaaaaaaaaaaaaatagccgggcgtagtggtgcatgcctgtagtcccagttactcaggaggctgaggtgggctgaggtgggagaattacttgaacccgggaggcggaggaggttacactgagccgagatcacgccatagcactccagcctgggtgacagagtgagactccatctcaaaataagtaagtaaatacataaattaattaattaaaaggaactgtctacctgatatgcaaagccccatatggaagtgggaggggagtaaaatcatatcccaattttcttagctagtgtttcctaatccatctttccccatacccaacattgaaacatacatgatgccagctgctaggtgattttcctaagtccagcttccgaattacccttacagccaatgtaagataacagcaactagcaattgtgtagactttttattttttgctaaatttttttttctcattttaaaataaattatagaccacacttagatgtctgccgggtggtggggagcggggggaaagctgttctgtagtttgttgtacaagtgcagggctcctcaaaagaattaaaaagtgagtggcagcgcatacattttggggacttagtgaaaagaagtgcccttcatggtgttgttggaaatgttcctgtattcccaagtgtgccttgattatgaaagcagtgccaaaattaacagacatgttttttagcatctataagctgtatatggtaagtcacagaggagactttcaaagtggccctattgaaagcattggaagagtggcgttttagaataaaatactgttaactactctgattaaattagacatataaatgaagatgtttttcaaaagtgcttcagataatcagatacatttctgaaaaaaacagtctcattctagtaaaagcacaaactactgacacttgaaatagcaaacaatattgtggtttgatctgagaggcatttttatctaatacgttcaaacacatgaagagaaacatcacttattgaaggcctgagacaccatgctcagtctgagttgtaatttgagcatgcatagagaactgcttggatcctagaccctatacgttactcatcttataagcagcctgaaaattgccttatccctgtccttaagacaagtattgtcataggactcaagttcattgacattgattctgcagaatatttctttctctcttgctctctctctctctctgtcttgttctctctttgatctaggtgttacagtttccaataattggtttctagccccttccccaagtgatcaacacttctctttcagccacccttatttctctaacttttgtacccttaatgatttcacagttatatcctcattatcttctcacctaccattatataaactgtattcctaccttgtccttaaattaacatgcacttatgggttttttttagccatgcatgtttaattcttcttataactgaattaatatgtggaccagccttctaggagcctgcattttctgtccctgaaccccagtttatccatgagtctatccccaatatctcctaccaaacctcatcagcatgagtcattgcccatttgtatatctctaagtttcttggtctactctggctgctacagacagcctccttaacattttgttgaccagtcttccagaagctggtcaaatcaacctcttctttcttgtagaatactgttagcctttggtacggtcctttagatttacagaatcagttgtctgtcctaaaataatctactcctgactttatttctctttagagcaggacctcttatcctccccttttccactctgagccatgtatagagaactgcttgtatccttgaccctgtgtgtttctcttgcttccacctgagctctaattaggaaaacttattctgaataaatgacacttggaagaacaaactctgacttacaaagtagcattatacagttttaagtatttttagctaccagctgtgcaagcaataagtaagagactttgaagtgctaaaaatatttgggaagtgtcaagtgggagttggcaaataccctggggtgagaaaagccctagatatgatacatctggcacacatttttagaatgttctatttttagtctgtgttttgatttctgaagagatccaggggtgtttcccttaaaaagaagcaaaagtgacagaaatgcctttagagaacaaggtaatttctgaagtattctttctctcttccctctgcccttcaaattaaaattggcatgatgcctggcattattcttaaatcataaatcactctgaaatctttagaagaaaagtgttctgtaatgtgcaattatgaataagaaaacactgcttgtaacagttaagtatcttgctttttggttacagctctgaggttatcactgccattatttttttcctagttattattattgactaatcattacaaaatcttctagctaattctttttagttggctcatatatgacacttattttggacagtatattcaattgagcccttgtcattgtggctcaataaataaagaatataaccaaaggaaaaataaaatttagtgatgcaagtttgtcttttggttcaagttctaatattaccaatcctcagaatatttcctgatttctagtctcaggaaatacagtaacttgaatacagtatggagctcctagataagctctctttatcatatacagatctcttgctggaagatctcctgtggccatcaatagaaatttaactcccaagcctcctaattagtattaaaaacggggagagagactggggatgggtgtgagtgtgctcatgtattgaattggggtaagaggcaacagagagtccagtcaaaaaatcttagtgaatcttacttttctactatatccctaaggttctgaaaaaaaaaaaattagctcatgggttaagaaatgcctgaaacttacacacttaccagtacaatttgttaattaatagagttttgagttaaaaggtaagtattgattatcagcaagtctttatacagttatcacctctgatttccaataatgccatggattattaaaccttttatttcttgtcagccccatgtcacgtcttgtacagtttgtataaagacacttgatatcccagacttcctcaaggaatctgtcactttctctgtatgttcttaaaattttcagtctcctctagtgatagtattggtttgctgtaaacatttcctgattctgtctgacaagagactgttagtctttgaacaacaacaacaaaaatctctgaaaaataatctgagaaatcctattgcaatactatcattagtgtaatggtgatttaaaaatacgtttaaggtattacaattttgtgatgtcttttcacagagatttagtttataaaaaatccaactcatttgtaaatatcataaactatttgttaatatatttatgtctttacaaccatttcaagtttttaacgactaagcattttttctcgaactttcaaaaaaaatgtatcttaaaaatttagattgtttttaaagaaaggtggttccaaaatgtatgttttggttctattcagtgtaattgtggagtgtccacatagtcttaaatttatatattaaattattttttagataatttgttgagatcattaaacaaatgtttagttttcagaatgcactaggaggtgaattataggtatgggcacctataatattacctatatgctttttagtttctattttgatattgtgttacaaatgtctcaggttttaaatctcctttaaaaactcagcagaaagagaaatttatttgattatgtgttgggatatagttgcaaaaattaaagataatagcaatgttgaaatttggccagtgatctgcattaactgaggagaaatgaaaagtgtttctgtggcatcacaaacagccagctaaacctccaacaatttaaaaggcaacctacttcatcatctttaaagcagagggaaggttggcaagaaatatgcatcagcaatattttctagttgaacaaatatctgaatataattctaggcttatgtttccaaaaaatgtcccagaccatatttaaaaactgcttcaaattatgtctcttaaattatgtttatgattcatatattgaactttcattaccattaaagagacttattggatgtgtatgcatgagtgaattaagacatcgtgttttgtggtagttgataagaaagagaaggagagttaatggcctagaatgctgacgtttcatgggttcttcaagacagcgttcaccagggaaaggaaaacttttgatggcattcatcaaatttgtcagagaaattaagaattataaaatcttcctcttaccaacatgcagaatcatgcaggcgttcctttattttatagatacacctatgataatactgcaagtactaaaataataaagagagctatcaaatgattttttcccctgcaaggaaatgtccttcctgtaatcagtagctattatagcccagccatcgttagccattatattagccttctctttttggtcagtagcttaagaattgaaccataacatttataattcagtagtttctgcacacctgtctactttgtcactggctcaggggattttgatgtgcatgttttgcctcagtgagtcagtttcattgacgttcttgcaaaagttgcatacacagtataaactttcctgagaaagatacttctttgccataaggcttaaaactattcataaaataattctaattttaatctaagtgatctaaatttaagaacaaataccaaagaatcaaatccatagttaattcatgcatgatagataagtaaataattggtatttatatttgaagcaagctcagtgtttcaatgcaaaggttttatgcatctgtctgtaaaattgggattgctgttattgttctctgaattcatgaaggtcagtttaactaaaatgcaaaagttgcttatagcattatttacataaggatacaggtggaatgcaaaggaaggctgcatctgccatcatggaaataagttttatgaatctttaaatactacattagttgtctatgtatatttattttcctcattaagaaaaactgataagggataatggacatatctccttagtgtaatctggcataaacatcttaacggctctgacttcagttttatatttacttgtgttatcatctgattatctgtcttctccctttgattgtatgctccataaaatgagtccagtcagatcttgcttatcattgtattctctgaatctatcaccttgcctggaatctagtaaatgatcaataaatgtctgttgaattaacgagcaaattataagaaaagtgattcaatgttttttttaaaaaacttcaaaacacttgttcacacttgatcaattgaaacttgttaataaaaatacaaaattagactgtgtaatttaatgctagtactattggtgtttcccagaagcaaaagtgtatataggagaggaaaaatgtgttttctgtctgcccttctaagttcttggcagaggcctctgtaaaaaaaaaaagacatattaacaagagaaaagcatataaatgcatctaatgtaggttaatatgacacaggagtcttcataaggaaatgaagaaatgattaaacttgagtgcttttatgctaggcttgatgaagagtggaaagtcacagacaaaatgggtatgagctaagagtattaagctgagggaaacttggcaaggtctgtgcattcagatccctctcagcatccctctgccattgtacataagaatactcatttcctagttcatagcattaaatgactacatcaaaaagtctgaaagagtacagcttagacaacctaatgtcacaccttaaggaaccagagaaacagaacaaactaaatccaaacccagcataagaaaagaaatcacaaagatcagagcaaaaataaatgaaattgaaacaaaaaaaatacaaaagataaatgaaacaaaaagctgattctttgaaaagataaacaaaattcattgaccattagtgagattaaccaagaaaagaagacagatgatccaaatgagctcaattaaaaatgaaactggagattttaaaaccaacaccatagaaattccaaagatcattcaaggctactgtgaacacctttatgcacacaaactaaaaaatctagaggagatgggtaaattcctgaaaatatacaggctcctagattaaatcaggaagaactagagacactaagcagaccaataacaagcagcgagattgaatcagtaataataataaaaaatgcccacaaaaagtccagaactagatggattcacagatgaattctatcagacattcaagaagaattctttgaattcttcttttcaaattctcaaagaagaattggtaacattcctactgaaatgattccaaaagataaacgattccaaaagataaagagggaatcctccctaaatttttatatgaatctagtatcaccctaataccaaaaccatgaaagcacataacaacaacaaaaattacagaccaatatccctgatggacatagatgcaaaaattcccaacaaaatattagctaaccaaatccaacagaatatcaaaaatataatacaccatgatcaagtgggttttataccagggatgcagggatggcttaatatatacatgacaataaatgtgatatgtcacataaagagaattaaaaacaaaaaccacatgattatctcaatagatgcagaaaaagcatttgataaaatttaatatccctttataataaaaaacctcaaccaaatagacatagtagaaacttatctcaaagtaataaaagacatatatgacaaaccaacatcatattgaatcaggaaaagttgaaagcatttcccctgagaactggaacaagacaaggatgcacactttaaccacttctattgaacctagtactggaagtcataggcagcgcaatcaaacaagagaaagaaacaaagggcatccaaatttgaaaagaggaaatgaaactgtcgctaatcaccaatgatatgattgtatacctagaaaactctaaagtttcgttcaaaaagctcctatatctgataaattcagtaaagtctcaagatacaaaatcaacgtacgtgaatcagtagcactgctttacaccaacagtgaccaagctgagtatcaaatcatgaactcaatccattttgcaacagctgcaaaaaacaaacaaggagttgaaagatctttacgatgaaaactacaaaccactgctgaaagaaatcatagatgacacaaacaaacaaaaacacatcccattctcatggatgagtagaatcaatattgtgaaaatgaccatactgccaaaatcaacctacaaataaaatgcaattcccatcaaaataccatcatcattcttcacagaactggaaaaacaatcgtaaaatttgtattaaaccaaaaaaaaaaaaaaagcccacatagccaaagcaatactaaggagaaagaacaaatttggaggcatcacattacccaacttcaaactatactacatggctatagttaccaaaacgacatggtactggtataaaaatagacatgtagaccaataggacagaatagagaacccaaaaataaagccaaatagagccaactgatcttcaacaaagcatacaaaaacataaattggggaaaggataatctattcaataaatggggctggaaaactgacaagccacatgtagataaatataaatggttcctcatctctcactttttacaaaaatcagctcaatatggatcaaagacctgaagtcaaaaattctagaagataatttcagagaaactcttctacacatggacttaggcaaaggattcattcctaagactccaaaagcaaatgcaacaaaaacaaaaatgaataaatggtacttaataaaatgaaaaactttctgcacagcaaaagaaataatcagcagggtaaacagacaacccacagaatgggagaaaacattcacaaactgtgagtccaacaaaggaataatatccagaatctacaaggaactcaaatcggcaagaaaaaaataatcccatcaaacagaaggcaaatgatatgaatagacaattctcaagaaaggataaacaaccaacaaacataagaaaaaacatgctaaacattaccaattattagggaggtgcaaattaaaaccacaatgagataccaccttactcctgcaaaagtggtaacaattaaaaagtaaaaaaccgatagatgttggtgtcgatgtgttgaaaagtgaacacctttacattcctggtgggaatgtaaactatgaaaaacactgtgacaattccttaaagactaaacgtagaactaccattcaatccagcgatcccactactgggtatctacccagaggaaaatatattgttatacaaaaagacacatgcacatgcatgtttatagcagcacaattcataattgcaaagacatggaaccaagctaagtacccatcaaacagagtgggtaaagaaaaggttatatatatagatatatgtgtgtgtgtgtatatatatatacacacacacatacacacatacacataccatggaatactattcagccataaaaaggaacaaaagaatgtcttttgcagcaacttggatggattggaggccattattctaggtggagtaattcagaaatggaaaaccaaatatcatatgttctcacttataagtgagagctaagctatgaggatgtgaaggcataagaatgatacaatgtatatagctcaggtgacaggtgcaccagaatctcagaaatcaccactaaagaacttactcatgtaaccaaaaactacctctactcaaaaaactattgaagtaaaagtaattaaaaaaaaaaaaaaaaagaatacaccttttctggccagccatagtggctcacagctgcaatcttagcactttgggaggctgaggtgagaggatcacttgagggtaggaatttgagaccagcatgggcaacatggtgagacctcactctatttattttttattaatttttttttaataaaaagaatgctccttactttcaagtgtagggtgggcaccttccacattagggtcagaaagtctttcctgcacatgctgtttctcaaattccttcagctaaaaatactcaatgtccaagatgccatattttgagtagtctctctaaaatcctatcaaggagaaaattaaatatatgtatttattctaattcctcatttgcttagtaggtgccataagttttcaggaaaattactaaaaaaatttttttatcctatttggaagtctgttcaactactaatgacagttacaggactgaacctccttagaatctcttcttttctctgcttcttttcttgtttccttttctttcttttttcttttctcttcctttccttcttttctctttccttctcttcattctttcatctttctgttttccgatttttctttttctctctttctccctcccttcctccatttctttttttcttcctcctgcccaccctccctcttccctctctttcttccttcctttcctttccccttctctctccttccttccttcatctttcttcctttttttttttaaaaaaaataacatatgcctgtggtcctagaatactattgctgaaatgtccttggaaagcactttaagaataaaaaagttaaaagcaatgatgttcccagcattacactatcattttaatgtcagaataaaaacttggaaatagctagtgattcctaatttaaagatatctttattatgtagggaagtttatgtagaggaactttccctctgaggtttcaataacagagtcaccctgccaaattaaactgacaatagacagatgatcaaagcaaaaggcatagcaatttattaagatgcatataaacatgggagtcctgcaaatctaagacttgaagggccagatagctgaagcttaaataacctcttcatagcgaagagggaaatgggggatgtaggcaattgagaggggtagtaaatgacctttaggagaaatcaatgggcccaggagacagaaattagcttgtaaatgattctctttggaatatgagtgacactgaaagagacaatgtcttgtgacaaagtgtgtctaggtgttggttacattcttcaatcttccttcttgtgttagataatgaaatttcagggagggaatagaaggaaattgcgttccttcaggaagagcttcagataagggaacttcataaatagagttctaccttatgcttggtgggaagaaacaggagaaggtcaaaaagtccttggtgctgaggctgtttctaaggtcttttaatttccttgagttcaaaagtgctcagcatgccgaagcaccatactgtggagcgttgctctcttgagcttcaacaattacatttaagctagactgaaaaatatagccacaaagtattaataaataaaatagatataatgagaacaatgtatttaaagacatggatataaagatatattggataattctagcaaaatagcagattaggctgttggaaataggcctgctttctgccccaaacacataaatgctttgaaaaaactatgagaatagcaaaaaaaaaaaaaaaaaagtattattgctctccacataactgaatttgacagaaagaaagatttcccaggggtgaaaaacaaataatgaaaaagaaaatgacaggggaaggccaaatctctgatagtccgctggcattctggcattagataccggcaacaggactgtaggctgcagtccctaatgcccatttatagataaagaaatacttcatctcaaacaatggactagaatttaggcctctacatcaaataaagagcctaagcttattctttgctctgaataggaaaaatctatccatcgacctgcaaaatattagggaagctatttaatctagggatttgagtcagtgtgagggagaatcactgacaagcatcaaaaccccagcttccctataaatgaatgaaagttttgaagttatgttaaccatagaacacagtaatctacaggatgagaaatgatataaaaatagagtcggggtaactgatgctatttgagctctaggcaaaagcaagtttcataaataaataatctaatttcttgtaagatatccaaaagaaaaaaaatgaattagaagcaaaagtcaatgacatagtggcaaacaatgttttcagaaaagaaaaatcaatatgtgtgcacctttcatattgaagggtcacagtgagtcccaaataggatagtccaaagccctacccaagtttaactgcagcatgttaaaacaaagaaaaaactttacatctttgagagagagagattgagagaggtatgtagacaaaaagaattgaactgtgtaaaatattggaagagatttattctgagccaaatatgggtgaccgtgggctgtgacagccctcaggaggtcctgggaacatgtgcccaaggtggtaggggcgcagattggttttatacattttagagagcatgagacatcagtcaaatacacttaagaaatatattggtttggtccagaaaggtgggccaactcaaagcagggttggaagtggggagggggaggtttccaggctataggtgaatttaaacattttctggttgacaattggttgagtttgtctaaagatctaggattgatagaaagggaatgttcaggttaagataaaagattgtgcagaccaaagttcttttgaagtcttataatggctgcccttagagaaaatagatgacaagtgtttcctattcagatcttagttaatctctttaggattgggagggtctggaagaaaaagatctagctatgttaatagagcttcttttatagatgcatgttcttccccacaaagaacaactttgcggggctatttcaaaatacggcaaataaacatgttttggggtaaaatatttttattttcttccttgtctggtaatgttataccagagtcaggttggaaaatcatgatatatagggttaaataaaagccatctgatgagaatgtatgatttgtagggcatgactccccagtctctttagataggaatttgggcaagattaaaaaatcagtttagtcctcaggtatatactggctttctaaaaaatgaatgatggttagagcaaaagtggaagtctcatcagcaaaacaggaggaaaagtagaaagtactgagataaaataaccaactcagaacaatacccagcaaattaacaagaataaaactgaagtgaatatatagcaagcccaagaaaggaaaaaacaagacttaagaatctatcattcaaaaatcctcactgacagaaaaaccaccggaattatttcagaaagaagttaattaaaccttaaggaacaagtttgtttctagaaaaaaatagacaaaaattttgattaacctaaggaattcttgtcactaagttcaatattactgttaaatatactgactagttttgagtgtctaaaacaagaggaattaaatagtagacaatagtaaagtagaaagatagaatgaggaagattgaaaataaaagtgttctattttctgttgtctaagaaatgtacagttgttccttggtatccattggggattgttttcaggaacccccctgggataccaaaatttatagatgttcaaattctgtatatcaaatgcactgtatttgcatatgacctgtgtgcatcctcctttacattttaaatcaactctagattacatataatacccaatcaaatataaatattatataaatagttattgtgctctatggctttttacactgtatttttgttgttgtaatgttaatatttatttttaatatttttaatctgtgtttggttgaatccacagacagaatccacaaatatggagggccaactgtatgaaaatattgtttttatttttagtttagtttgttaaatcaagcttacttgtcaaaagaggaataaagaaaccaattaaaaagtaataataaataaaagccaccaaccattgtgttggaaatgaatctatcatgtcattccaatgaattacaatgaatataaacaaattctcccattaaaagccacagtcgtgcactagattagaaataataaatccacaaatacactatttaaaacatgatgcagaaaagataaaaataaaaagattgaaaaagatataataggaaaacgataatccaaataaagttgttaaagctgtagtgatctaataaaaaaaaaaagcttgaaagcaaaagacattgctaaagtgggtcagtatgaaataatagacagcacatttcatcaggaacatacaccactcctgaatgtattttgcattataatcccaaaatacatgataaagatgtacaagaattataagtttagattgataagtctacagtcagaggggaagatactattgtacttctttcagaaactatcttatcaaacagacaaaagtaataatatggaaaattaaaaacacaattaaaaaatcttaaattaattcatgtatttgaaagaactctttattctttttaagtgttctcacaaattaattatgtacttattcataaataccaaaggatgaactaaatatactcagatctaaatgtaataaaattagaaaaaaattatgaggagagcaatcagatacattcaaacactgagaaacatacttccaagtaatccaagaatcaaataaaaaagtataatggcaattattaaatgtttaaatcttcaaaataataaaaccaaaacttaaggaagacaagctaattttatggaaaaaaattatatggtcttaaatgagatttttataaaggagtaagaataaaaattagataagtattcaactaaagaaattcaaaaggccaaagttaaccttaataaataatacatacataagctaaaagcagaaattaatagaaacaaatgattaaaaatagaatggccaggtgtggtggctcacgcctataaccctaacagtttgaggacgaggcaggaggattgcttgagtccaggagcttgagatcagcctggacaacatagcaagacagtgtctctacaaaacttaaaagattagctgggcatggtggtgtgcacttgtggtcccagctactctggagggtaaggtgagaggattgcttgagctagggaggtagagctgcagtgagccatgatcatgcaactgcatgccagcctgggcaacaaagtgggaccctatttaaaataataataataataataataataataataataataatagaatgtatctcaagacaatgagaagaaaacctacatactgggagaaaatatttacaaaagacaatctgataaagaactgttatctaaaataatgtgatgaagtcttaaaattcaacaataagaaaataacctgattaaaaattgggtttaaaaaaatgaacagacatctcaccaaataagatattcagagggcaaataagcatatgaaaagatgcttaacatcatgttattagggaattgcaaattaaaataactaacagctatttaatattattatagcaaaaatgtaaattactgacaacataaaaagtggccaaaaatgtggagcaatagaatctctcattctttgctagtgggactccaaaatggtacaatgactttaggaaacaatttggcagtttcttataaaactaagtgtgctcttaccatacagtctatcagttggactccttggtatttacccagaggagatgaaaacatatgtctgcacaaaatcctgcacacagatatttatagcagctttattcataattgctaaaacttggaagtaaccaagatgtccttcgttgagtggataaataaactgtaatgcatttagataagggaatattattcagtgctaaaagaaaatgaactatcaagcaataaaaagacgtggtggaaatttaactgtatattactaaataaaagaagccaatttgaaaagacaacatgttgtataattccaactatatgaccttctggaaaaggaaaaattatggagacagtaaaaaagatcagtggttgttagggattaggaggagaaagagatgaacagacagagcacagatgatttttaagacagtggatctattttgtataatatataatggtaggtacatgtcattatacattcgtcaaaatccacaaaatatacaataccaggaatgaaccctaatataaattgtggactttagaagataatgttgtgtggatgaaggttgttcttggtcctttggctagagaggaccaagatctttgatgtggctttttgtggttgtgcccattgacatttctgggttgtcaacttaaatttaagtatatataaggcaaaaggaaatccaaggtaacttatcctcatgtcattccttgggccctgaagtcccttagagtttccttatgtttattttatagacaatatctaaggtttttagttgtgcctagatgaaggaagctcttccgttttctctgaaacagaaattcagtttcccactttgccaagaaaattaaaataatcctaagaaaatctacaaactcccatgaaatatgtatctactcatagttatctgtattaatatagtcttatctcatatcctagactctctatggtcttgtataaaaaaatccccaaattcatcaagattttgaaaggatctatgtgcttctacctcctcattagactacattcatctttttcattgtgccatcgcaggcaacattctgtcatacaattggtgcttagtaaattgtgacaaaaattaacaaatagtgctattatagttttcataatatgtataagaacatttaagtttccttttaattttatgagttgactttatatgtataaatgaggagagtgaatgaaatagagattgaagtagagtggaatagagtgaagggagattatgttttggtataaaagatatttgagtgagtgtgtgtgtgtgtgtgtgtgtgtgtgtgttttgcattgaattatcgtaaggtctttgttctgttcactgatatatcttttaagcttgaaaaaaaaaagcctggcatattctaggtgcttgattgatcatcttgaatgaatgcatgaataaacagtgatgtattacacttaaaaaaaaccaatggtatttaggttagaccacgtgttaccatcaaatgaaaatataaagtcttttctagtcttgggaccttatatattatgtgtgttggttcttcttggcatttatttcttaaacatttccattctcctttaagtgattttatcactgcctcttttatattcaccactgagtatcttatggcactgaatatagcagacctcatttataggagcaatattaacctgtattgatttgcagtcatgtaacatttaaatgcaaaaaggtttattaatggcattctttcccaaagaacagaaaaacagttgcatgcttaaatgtatgggtgtgacttgtcatgcatgctgatgtattctaccattgttatgcttgccagctgcaaaccacaatcagaaaacccctagtaattataatagaacaaattaaaaagaggaaaatcttctttctctctgcttagctttcgtgaatacgggaagtcaaaaataaaaatcaggacttagtaaatttttgttgttacagaaaaggtatttctctattttatgtattaataattgaagttggaaacagtttccactggagcttgttacacagcagcagccctttcacccatctccaggccttgaaagtagtggtatgtaaactacaggagtatgattaccagcataggtattgggggaaatgcaccacaatatcctttccatatgatagattctatttggacttttctgttagcaagcacttgcttacattgtagtatttttctttgtaatttccaattatgtaaaatctcaagccatacagcagtaaattaaatttgtaataaaaagttttgagtttaacttcctctgacctggagtcttcacttttgtagagaagcaaaagtatagcctttgttttcttgcttagtttagtttattgagataatacaaagtaaaactcatcctttatagagtacatttcaatgagttctgataaatataaacaatgtgactaccactacaatgaagatatgcaacattctcattaccccaaagagttgccttgtggctctgtgttttcaatctcctccccaaagttagcccctggaaaacacagatctgatttctgcacctataactttgaattttctagaatgttatataaatgggagccacattttcttttaaaagaaaatttaaagggctgtgtacctttctgtatttgtcttccgtcacttagcatatgcttttcatattcattcatttcatcgtatgtatcagttcctttttataactgaatagtattgcaatgcgtggctgtataaaaatttatccatttacagtttgttagacatttaggttattttcagtttgtgatcattatgcataaaagtgctataaatatttacaaataaatttgtgtgtagaaatatattttcctttatgttgaataaaaatccaggagatatttatgggattttggtgagtaaatgtttaacattgtactggtatctcagagtgttttccaaagtggctatatcatgttgcactcccaccagtagtctgtgagagtttaggttattccatatcgttgttaggacttggaattgccattaaaaaattaatttttgccattgtaaaaagtatgtaaaggtatcacagtgcaatttttgtttgcattttctaatgactaatgatactgaatataatttatttgtttcacttttgtatttttgtttataaagtgttcaaatattttgcttatttttattgtattttaaaattttataattattgagttgcaaggttaatatttgcattctggatgcaagttttatcatacacacatacatatgtagccatgggttctgcatctggagatttaaccaactgcagatggaaaatattcagaaaaaaacactaaaaaataataatacaacaataaaacagataaaaatacaaaaatattataacaactatttacatagtatttacatagtattaggtaataaaagtaaccagagtcatttaaaatatacaaaaggatgtgtattagttatatgcaaatataggttgagcatccctaattttaattcaaaaactggaaatctgaaatactccaaaatccaaaactttttgagtgctgacagactcaagtagaaaattctataattagtacttaacacaaaatttgtttcatgcacgaaagtattaaatatattgtataaaattacctttgggctatgtgtgtaatgtatatataaaacataaaagatggggttgtttttttcttgtaaatttgtttaagttccttgtgggttctggatattagccctttgttagatggatagattgcaaaaattttctcccattctgtaggttacatgttcactctgatgatagtttcttttcctttgtggaagctctttagtttaattagatcccatttctcaattttgacttctgttgccattgctttggtgttttagtcatgaagtctttgcacatgtctatgtcctgaatggtattgcctaggtttccttctagggtttttatggctttaggtattacgtttaagtctttaatccatcttgagttaatttttgtataaggtgtaaggaaggggtccagtttcagttttctgtagatggctagccagttttcccaacaccattttttaaataagggatcctttccctattgcttgtttttgtcaggtttgtcaaagatcagttagttgtagatgtgtggcgttatttctcaggactctgttctttttccattggtctatatatctgttttggtaccagtaccatgctgttttgtttactgtagccttgcagtatactttgaagtcaggtagcatgattcctccagctttgttctttttgctgaggattgccttggctatatgggctctgttttggttccatatgaaatttaaagtagttttttctaattctgtgaagaaagtcaatggtagcttgatggggttagcattaaatctataaattactttgggccatatggccattttcatgatattgattcttcctatacatcagcatggaatatttttccatttgtttgtgtcctctcatttccttgagcagtggtttgtagttctccttgaagagatccttcacatcccttgtaagttgtattcctaggttattttattctctttgtagcaattgtgaatgggagttcactcatgatttggctctccgtttgtctattattggtgtataggaatgcttgtgatttttgcacattgattttgtatcctgagactttgctgaagttgcttatccacttaaggagattttgggctgagatgacagggttttctaaatatgcaatcatgacatctgcaaacagagactatttgacttcctctcttcctatgtgaatacactttatttctttctcttgccttatttccctggctagaacttccaatgctatgttgaataggagtggtgaaagagagcatccttgtcctgtgccggttttcaaagggaatgtccacttttgcccattcagtatcatattggctgtgggtttgtcataaatagctcttattattttgagatacattccatcgatacctagtttattgagagtttttttttttagcatgaaagggtgttgaattttatcgaaggccttttctgcatctatttagataattatgtggtttttgtcattggttctgtttatgtgatgcattacatttattgatttgtgtatgttgaaccagccttgcatcccagggatgaagccgacttgattgtggtggataagctttttgatgtgctgatggattctgtttgccagtattttattgaggtttattgcgtcgatgttcatcagggatattgggctgaaattttcttttttttttttttttgttttatctctgctaggttttggtatcaggatgatgctggcctcataaaatgagttaggaaggagtccctctttttctattctttggaatagtttcagaaggaatggtaccatttcctctttgtatctctggtagaattaggctgtgaatccatctgttcctgtgctttttttgattggtaggctattaattactgcctcaatttcagaacttgttattggtctcttcagggatttgattcttcctggtttagtcttgggatggtgtcaaaaagtgggcaagagatatgaacggacacttctcaaaagaagacatttatgtggccaataaacatacgaaaaaaaagctcatcatcacttgtcattagagaaatgcaaatcaaaaccataatgagataccatctcacgccagttagaagggtggtaattaaaaagtcaggaagcaacagatgctggagaggatatagagaattaggaatgcttttacactttttttgggagtgtaaattagttaaaccattgtggaagacagtgtggcaattcctcaaggatctagaaccagaaataccatttgacccagcaatcccattactgggtatatacccaaaacattataaatcattctactataaagacacatgcacacatttgtttattgcagcactgttcacaatagcaaagacttggaaccaacccaaatgctcatcagtgatagaccggatagagaaaatgtggcatatatacaacatggaatacccagcagccattaaaaaggatgaattcatgtcttttgcagggacatggatgaagctggaaaccatggttctcagcagactaacacaggaacagaaaatgaaacactgcatgttctcactcataagtgggagttgaacaatgagaacacgtggacacagggaggggaacatcaaacaccagggcctgtcaggtggtggggggctaggggaagggaggggtagcattaggagacatacctaatgtagatgacaggttgatgggtgcagcaaaccaccatggcacgtgtatacctacctaacaaacctgcatgttctgtatatgtatcacagaacttaaagtatatataaaaaagaaaaaaaaacttaaaagaattttgtgtttagacttgggttccatccccaataaatctcactatgtatatgaaaatattcaaaaatccaaaagaaatctaaaatcccaaacaattctggtcccaagcatttcagataaggagtacccaatctacactgtgccatttcacataagcaacttaagcatctgtggattttggtatccacaggggtcatgcaaccaattctcaaggatactgaggaacaattgtatatgttttcacacattttatctctttgtaaattgtgttgtaattttcttaataatatctgtagtgtgctacaagtgatatttcatggttataaaattagtgatagacaaaatatctaattaagtgtcttgcaaggacaatactacctgctacttaatggtagatggtaaaagggcccaggagactttccagatctccttgataaccggagatggggacttcccagagaccccaccaggatgggattttaagaccctcatagcaaacatgcctgggtattactgggtctctatgataatgagtcctaaaaaaccctagttgttctagagacaaggtcgcctcagcacagaaacaaccttcgtgtactagccacccatccatttttttttttttttttttttttttgagatgagggtctctcttgtcaaggctggagtgcagcggtatgatcatgggccatcgcagcctcaacctccaaggctatgaactttaaaacaaagcttacccttccaagaatagcttaaagtccctttatgaaagaaatacctggtaactgacctagatttaatgccagtataagaagaggagaagaatcccccaaactctgagaatagcctccaaacagagatcctccctgactgaccccctgcctgtacctggcccatgccaccagcctgctcctgctgtccatctgataagagccctgcctaaatagacctcttgagcattagctggtgtctaagactcatctttcatgtgtaatggatggaagaagagaagtcaccccagggaagctggtcaactaggacaactggggaccaccgaagtgacattatctttacaaaaaggagaggtggtttttgttgttgttgctatttctaatgttgatggagtcctatttaccaatttatattttaggtttgtgctttttgagtcctgtttaggaaatatttttctagtccgcgatcacagaagttttatcttaacttctctagagtttcagatttagattttacattttgatctctgaccattttattttttaaaattaattttgtatgtgattacttttgtatactatgtgaagtatgagttgagaaagcgttggtgtgttttttttttaaattaacgtcatacatattttgattttttttggattgttctattctgttctgttaatctttacaactacttttccactaataccagagataaggtaatatgatcatggcgtgtaagtcatccaatcttgttctttttcaaaattgttttggtgattctagtccaaggtttctcaacccttgggacaattgaccatttgcgcttgataattatttgctatgggagggctgcctgggacactttagaatgtttagcagcatccctggcctctactcactggatgctaatagcatctttcccaattgtgatcaccaaaaatgtctccagacaatgccaaaaatcccctgggagacaaagctgtcctctgattgagaaccattattccagttctttgctatttcatttacattctagaattggcttgaaaatgtggcaaagaactgacataactttagtaacttttctaatccttgtatgtggcatatcttccatttacttaggtttttaatttcctttagcagggttttatagtttttatcatatagaaattgcagctctattgaccaatttatctaaaaataccttatatatttgatactattataaatggtgctttaaaatttactttctgattgttgtttgtaatacagtcatgtgctgcgtaaagatgttttcatcaaccacatatatgaaaatggtcctttaaggttataatatggtatttttactgttccttatgtttagatacataaatatttaccattatgctacaattgcctgcagtattcagtacagtaacatgctgtacaggtttgtagcctaggagcggtaggctatatcatgtaaagtatagtaggttatatcatctagatttgtgtcagtacacactatcatgttcacacaatggcaagtttgcctaacaatgcgtttctcagaatgtatacctgttattaagcaatgcatgacttatatagacatgcaatttatttttgtatgttaaccatatatcctgcaaccttgctaaactctcctgttagacctggtaaatctctgatagataccttaggattttctacttggacaatcatgtcataagtgaataaagatattttttctccaatgaaaagatttacgttgttatctgcagcagtagaaatatttccatgttgtttgtttaatttttatctatttatctatctaaattgtttatcagtttaattgcactgtaattaatttaattagattgtctatttatgtaactaaactgtctctgccattaagtagttttcagtaaggcatttcaaaaaatagatgattcaataagaaagctaactagagtctgttttaagttagaggtttagcatattttctaattatttactatctcattcttgcattgagagataacagtcacataaattttgaattcatgaaaacagattatttatttccttccagtggctgatatagactgtacctctgtagaacatataagacttaatgcccattttcttctatttttaagcctctgtgctattttgtaagtctttgtatacaaacagaagttcagtcaaagaagtaagaggatcatattatatacgtatagaaaatatgttttttttttctctttatgcctttgcaggttttaagaaattgctacccatatttgaattcttacatttggtataaggatcaaattagattatgtatataaaatcctattttaagctgtaaaatgagaggcaaatgctagctagatatggcttacgcatgcagtaaatactccatatatagtttttgaattgctagtccttttcagatatacagaaaatttccattgaaccttaaaagcctcaagaagaaagagaagtgagctaattttttttttttggctcagcttttactctagttactggtacataacgtacctctgaaaatattactaagcaattaggacagagttgttttatgagattgacagtgttcttttaaatgccacctatccagtgcacatagttgaatttttctactttgcaggaatttgtgcaatttctccaaataagaaatatttggaggactctagcatggcagaaaacctcagtgggtctgaattgtctaggaccatacatcggaaggatgatgcttcttttctatgttagtgcttagtctctgctattccacatttaatgctttctctgtctccttaaaaacatttccaaataaaaaattaaagaaaatctgataggtatgcacttgcagacattgcttcaacattttgtattaatatagaaccattggtcagtaattatgctgaatatgatttagaatagaaactgaatttgaatcttacctgttacctgtacatttcttcttcaaaggaaaatatattttgtgtacatacacacacatgcgcgtgcgcacgcgcacgcacatatataatgtctattatttctgtaattgattctgcaatgatagcaataatatattttatttgataatatctccaaaaaacgttgaaagttttaagatgtacttactttctgttgcaaaaattacttttacattcaagaagttcaacatctttattacaaaaggtttctgggaaaaatatagatttctataaactatatatacatggacacaggagattggtttatggagatgagcaaaatgaccatcagacactcaccaattgcactgaactcaaactttaaaacaaaacaaaacccattaatatgcaaatgtaggcaactcctgcattctttaacatatttctgaataacttctaaaaggataagtttttcttcaataaatgatgaaacttcaagtttaaaatatataaacactaaaaaaattgatttcatatccaagggtgaatttctctttatttatatctgtatccagctggtagtgggtggtatctcattcctggaaattcatgtattggaaaggaaatgcttaagagaatattcatttagctacaaagcaatggcatttcaagctctgaaatgtcatttggaggagtccctgattccatgggggagaaatgtggctgttctttggcagacttggtaaagctcacttctcagattgatgggtctcgtaaagtcctattggctttgttgactgagctgtacatatcagtatgatttgactgggcttgtgccatattcacattgtgagaattattgtcattagtatcattaatatgcatgcattctccttgttgttctttggatctgtctgaaatttttagagaaatagaatactggcgaggcctcaaactgatgactgtgtgcatttttattttaaaaataaaagcaatttattaataaccatgcatgggaccaaggtggataactaggaaaaccatgttacaattatgtggttcataacaaaatcatttttatgtgcaaatttgatttgtgttattttttgtcttatctgttaaaatatcttttatgttttagtactttgatatagctgattatagtgatgtagtcaggcttttataaatctaatattaatgcaggttacagaaggggaaagaccttccttttattgattgatttttaacagcttttgttcttaatgatcaaaataaaagagttcatgccagaaaacttggaaagtactagagcaagaaactccaaacaaaagacaccgtaatctataattcccatagatgcctttgatattttgatctgtttgtctttcccagcttagggaacactgtggcaaaaaagttgggtttctaaagaataaaaacactcacactcttcctcgatttttgttgggctgagtccacctcacacattgaatggatacatggaagagtggcaactacagtaagaatactgatcacatggtacctgattgatttgcaagtgttacttctgggtacaggcagtgggaggaatcctgttaacctattatataaaaagactagcattggtataggaattcgaagtgtttcctaccgctgtagaccaactcttacctggtgtcaggattgagttatttgtctggtccactagactcagagcttctcctaattttttatttcctttatgtttgttcttctcttgaaacttatggagacctaaaggccctatgtgattcgattccagtattccactccaaatttatgtactttcattctccagtttgctcaatcagatacagtgatacattccttctttctgatttgctctgaaacatgtcaaactcattccttgttcagagatcttaggctgtattaacataatctggaatgtccatttccctgctctaatgtcactttctcagatagacctcccttcactactctctctaaataaccctccagttaacacctatctttttgtttgaccccatttaaaaaatagaacacattatttaaaattgctttgaggtttttatttatgtatttattgtctgtcttgattttctgtcacgttcccccaacctccgagcactgtgatattagaattgaggttgtttattttgtacatctttgtatcttcattgtttagataattttagcacagaggcaatgcctaataagtaaatactgaatgaatgttggataatagagcttggttatctgtttgcatgaatgtgattattagataagttccagatcatagaatcttaagattcttctttatactcactcaagacaaagaggacctagtctcccaaaacaaaaaggttgtctaccttccccatagaaaataaggaggattttcattccttcataatataaatatatgtttaatactacacataatttttattgattgcattctattatatggatataaaatatttttaatcactaacattttactgttgatcattttattttcttccagttgttctgtattatgaatgtcacctctgtggatatttttgtccacatatttgtgtaaaactctgattatttccatagactacatttgttgaaatgaaattgctatattaaaatgtatgcccctctttcagtattttccatactaccatttgaaagtttgactgattaaatacttatggtttaaacactcataaggaaaaatagatattttcagaaaagtttgaaattcttggatacaattttttgagttttcagttttttttaatttaactgcattgttaaagtgaataaagattgacttttttttccaaagtgagaatcagagaaaactaatttgtctgtctcactctatagccattttagccaaaataggaatgtgaattgtttcaaattgtcattctttcttacttctgtttactgttactcttaaaataattgagggtaaccgaaaaataaggcttgaaacacatcagcaagagattgtattcatattgctcattgttttaatgaatagaatcctttaagctaactttgagggatgtgtatctcttttcttaaaagttaaatgttacgttttatctcacaaagatgtcaattagcatgctataagagaaactctttctaaaacatgccccccccccaccacgggtggcatgagcagatatttaatgcacctgctgccttgcaaaaatatcaatcacattgtactccaaaaatgtccaagtaaaaaaggggcaacatttaaaatgtgtggttttggggtcacctgttaaggtatctttagtttcctttcctagaaaaatgattttcttcactgataatatttcagctttgcttttaagaaaagttaatgggtgaaaggatggagtttaaattcttaacagtgggtaattcacttattttcactatttggttttacaatttgaaaaatgagcatattttagaagacacttccccaagataagaattacgtgagtctgacaggaattattaagtatagcgagggaagattggagaacaaagtcattttgaatacatcttagaaaaggagatttttgggcagttgcggctcacggttataatcctagctcttagggtggctgaggcgggaggatctcttgagctcaggagtttaaaccagcatgggcaatatcgtgagcccttgtctctatttaaaaaaaaaaaaaaggaaaaaaaagtttttttctttttaaaataactatgtggtaaatactttttgaatgagtttacataactacctgatgcaatatattttccatgaggagcctcatatttctgagtcctcaatagaaaaaatgagtttttaaaggatattccatataaacaagtatgttgctttttactataaagagtagctaaaatttctccttaagaaaagtattattttatctacatgagaggctttaatgtctttttggagctgaatattatccagaagccctcaaatttatagaacaaatgtgaagaatattaagaattctatctagctggaaaagcaagcctttgtcttaggaacctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaacaagaattcgtaagatgccatcatcccattgacacaactttttttaaattccttatggctctttttcctgttcttatgagaaaatagtgagatgttcattacttttctggactaccatagaaagtacaaagccctgagtttatttgaagtctcacacttagtacaattctgaagtttcagtgtctaatttctgacaataatccaaagtcatatgataaaggttgcatagtcattcctcctataggggatatatagggattcccgaagtggcagaagtcaccttctccctgactgccaactgcagatagtgaagaaaagtgttcaagacagtttcttagtgaaactctctgggcctcatgaaaatatgaaaaatagtaaacacaaatatgtaaatacatatatatgaaaatatatcagatataaatataaaatctttagagatatttaaaatactcaagttggacaacatgttgactacagttgacaatatattgtattattgaaagatgttaagaaagtggatgtaaagcattcttacaacataaatgataattatgtgaggtaaagcatgtatcagttagatttagtcattccactaatgtacatatactttaaaacatcatgtggtacatgataaatatatataattttatctggcccttagaaaaataattttaaaaaatcaatattgatagtttatctcatgttatagtctgtttgaaatctgaagttaaatcatatttactatgaacaaaaggtttaaaaattaaaattcaagctgattctttaaattttaaaattatttttaatttttatgggtatgtagtaggtgtacatatttatagggtacatgagatattttcatacaggcatacagtatgtaataatcacaggagggtaaattgggtatccatcacctcaaatatttaccatttctttgttataaacattccacttatactttattacaaaatgtataataaattattgttgacggcagtcaccctgttgtgtaagcaagtactggatctttttctttctttctaacaatatttctgtacccattaaccatttccaccccctgacttttcccagcttcttgtaaccatcactctactctctacctccagcagttctattgttttaatttttagctccccaaaataagtgagaatatgtgaaatttgtctttccatgcctggcttatttcacttaaaataatgtcttccagttctatccatttcgttgcagatgacagaatggcatttttttatagctgaatagtactccattgggcatatgtaccacatttttcttatccattcagtctgtggatggacacttagattgcctgtaaactttggctgttgtgaatagtgctgcaataaacatgggagggcagatgtctcttcaatatactgatttcctgtcttttgggtatattcctagctgtgggattgctagaccatatgaccattctatttttagtcttttgaggaaccttcattccattcttcatagtgatgttactaagttacattttcaccaacagtgtactagggttccctttttcgcacatcctcaccaatatttgatattgcttgtcttttaggaaaaaaaaagtgattttaacaaggatgagaaagtatctcattgttgttttgatttgcatatctctcatgatccttgacactgagatatacctgtttgccatttgtatgtctgcttttgagaaatctatattcagatcattgcccattcttaatcagattatgaaattttttctcattgagttgtttgaactccttatatattctggttattaagcctttgttggatgggtagtttgcaagttattctcccaatctgtgggttgtctcttcattttgttgattgtttcctttgctctgcagaagctttttaatttgatgtgattgcacttgtccatttttgctttggttgcatacaaagttgagtaatacccccaaagtgcatgcaaccaaatccagtgtcctgcagaattttgcccaatgtttccttttagtagtttaatagtttgggatctcagatttaggtttttaacccattttgatttgatttttgtatatggtgagagataggggttcattcttctgcatatgcatatccagttttcccagtgccatttattgaagagactgtcctttctccagtgtatgttcttggtacctttgttgaaaatgagttcactgtggatgtataggtttatttttgggttctctattctgttccattggtctgtagcataatttgaagtcaagtattagttctgtagtatattttgaagtcaggtaatgtaattcttccgtttttgttcttattgctcagaatggctttggatattctgttttttatggtcctataacaattttaggattattttttctatttctgtgaagaatgtccattggtattttgatagggattgaattgaatttgtagatttctttggttagtattgatatttttaacaatattgtttcttcccatttataaagatggaatatttttccattttttgtgtcctcttcaatttcttgcatcaatgttttaaattttcaatgtagagatttttttggttaattcccagatacttgattttatttgtacttattgtcaatgagattatttttacatttctttttcagactgttcgtcgctggcatatggaaatgctactggtttttgtatgttgattttgtatcctgcaactctactgaatttattagttttaatttttttggtgaactctttcagtttttccaaatatatgattatgtcatctgcaaacaggcatacataatttgaattcttcctttccagtatggatgctcttgatttctttctcttgtctgattgctctagctagggcttccagtactatattaaataacagggataaaaatgggcatctgtttcaggtttcatatattagaggaaaagctttcaggtttttcccattcactatgatactaccagtgggtctgtggtacatggctttctttgtgtgtggtatgttctttctatatgcaggctttgatggtttttatcatgaagagatgttaaagtttatcaaatggtttttcagcatcaattgaaatgatcatatggtttttgtacttcattctgttgatacgatgtatcacattgattgatttgtgtatgttgaaccattcttacattactgcgatagatctcacttggtcctgatgaaggacctttttaatgtgttattgaatttggtttgctagtattttgtagaggatttttgcatcactgttgatcagggatattggcccataaattcttttttttttgatgagtctctgtctctgcctcgttttggtatcagggtaatactggccttgtagaatgagtttggaagtattccttcatcctctatttttttttttgaatagtttgggtagcattggtattagttcttttttaaatgtttgataaaattttacaatgaagccatcagatcctgagtttttctttgatggtagactttttagtatagcctctattttactacttgttattggtctgctcaagttttgaatttcttcatggttcattcttagtaggttgtaatgtcaaggaatttatccatttcttctagcttactcaatttattagcatagagtagctcatggtagtctctaatgagcctttgaatttttgcaatatccatagtaatgtctctattttatctctgattttcttcgtttgggtctcctctcctttttattagtcttgctggagttttggcaattgtgtttttcttttcaataaactaactttttattctgttgttttcttttttcatttcaatttcatttatttctgatttgatctttattttcttttccttctactaactttggatttggtttgctcctggtcttctagttctttaagatgcatcattaggttgtgtatttaaagttttttcttttttttaatgtttgcccttattactgcaaactttcctcctaatgctgctttctctgtactccatagattttgtgtgttgtgttttgattttcgtttgtttcaagacattttaaaactttctttttaatttcttcgttgactcagttgtcattcaggaacatattgtttaattttcatgtgtttgtgtaattttcaaagtttctcttgtcattgatttctagttttattccattgtggccagagaagacacttgatataatcttaatatttttaaatgttaaagcctttttttgttgcttaaagtatggcatatctttgagaatgattcttgtgctgaagagactaatgtggattctgtagccattgagttaagtgttctgtaaattaggtctatttttatatagtgaacattcagtctgagttttctttgttgattttctgcctggaaaatctatccaatgctgaaagtgaggtgttggtcttcgtctattattgtactggggtttacctctctctttagcgctaataatatttgctttgtatatctgagtgctccagttttgggtgaatatacatttgcaattgttatatccccttgctgaattgacacctttgttatttctttatctcttcttacagtttttgtcttgaaatctatttttttctaatatgtctactactgctctctttttggtttccattgccatgtaatatctttttccctccctttattttcagtctatgtgtgtctttctaggtgaagtgtgtttcttctaggcaacagaccatttgctcttgtttttttttaatttagtcatctactctgtgtcatttaattggaaaacttagtctatttatattcaatattaagtaaagacttactactgccattttgttgtctgttttctggttgttttgtgattcattctctcccttcctccctctctccctccctgcctccctccctccctccctccttccttccttctttccttctttccttcctttcttccttcccatctttctttttgtgaaggttattttctatggtggtatttttaatttcttgatatatatgtttgtgtatccattgtgggttttaaatttgaagttaccatgagacttgcaagtaacatcttatattccattattttatactattgacaacactgattgcaaaaacaaacaaaagaccaaacatgcaagagaaagctagtaaaactttacactttaatttcatcctctgcttttaaacatttattggttctatttatattatgtgtatgtcttgaaaagttattgtagttattatttttgatcagttcattttttagtctttctactcaatatatgagtaatttatacaccacaaatacagtgttgtacaaaacacccatgtttttctttgtatttaatatcatcagtaagttttgtaacttcagatgatttctttttgctcagtaagtcccttttccttctgattgaagtactctctttagcatttcttgtaggacatgtctgtgatgatgaaatccctcagctcttgtttttctgggaaagtctttatttctctttcatgtttgaaggacaattcactggatatactatagataaaggtttttttcccctttggcactttaaacatgttatgctactctctcctggcctgtaagacttccacagaaaagcctgctgacagatgtattggagctcctttttatgttatttgctttttcctttctttcttttttctttttctttcttttttttttttgctgtttttagaattctttctttattcttgaactttgagagtttgattattaagtatcttgagatagtcttctttagttgtatctgcttcgtgttctataaccttcttgtacttttcaatattgatatgtttctctatgtttggaaagttctctgttaatatccttttgaatgaaagctttctatcccaaactctctctctacatcctctttaaggccaataactcttaaatttgcccttttgagggtattttatagattttgtaggtgtgcttcattcttttcttttttttttcttctttttcctcttactctgtattttaaataccctgtctttcagctcactaattttttcgtctgcttgatcacttgtgttgttgagaaactcctatgcattctttagtatataagttggatttttcagctgcagaatttctgcttgattcttttttttttattattatactttaagttttagggtacatgtgcacaatgtgcaggttagttacatgtgtatacatgcttgattcttttaggttattttaatctctttattacaattatctggtagcatttgaattccttctctgcattatgttgaattttgttgagcttcttcagaaaagctattttgaattctctgtctgaaaggtcacatatctctgtcagtcatggtttggtcactggtgccttatttagtttgatttttgagttcatgtgttcctggatggtcttgatacttgtggattgttggtgtttgggcattgaggagttagatattcatcgtagtcttcacagtcttggctggtttgtatctgtccttcttaggaaggttttccaaatactcaaagggaattaattgttgtgatctaagtctttgttcactgcagccatatctgcaataggaggcactccaagaccagtcatgttgtgactcttgcagactcttagagttaaccatctttgttttcttggataagatcaggaagaattctctggatttccaggcagagacttttgtttctttcccttactttccttcaaacagagtctctctcttcatgctgaactccatgaagctggggagggggtgacacaagcatcgccatggccatcaccattgggactgtgctaggtcatacctgaagacagttcagcactgggtttcacctaaagcccacagtgaccactgccttgctactgctgatgttcattcaaggcccaagtgctgtacaatttacagctgcttattccagccagcctattgtccttcccttcagaccagtgagcttctcccaagcccaagcaggtctgtaaatgccatctggaatccaaggcctggaatgtggaaacttaggaatctacttggcgctctgttctgcaactgagctgacacccaaactctaagacaaagtccttgtcactcttccctcttctttcctcaaataggagtctcttctcatagccaccacagtaggaatgtgctgtgtcacacctgaagccagcatggtgctgggtcttacccaaggttcacagcgcatactgcctgcctaccactgacgtttattcaaggcccaggggctcttggtcagaagatgataaatcctgccaggagtgagtacttcccttcaaggcagtgtgctccattctggcccatggtgtgtccagaaatgtctgggagctaggctccaaaatgggggcttaggactctacctgatgctctattctactgtggttgagctattatctaagttccaagacaaagtcttcttgctctcccctctcctctcctcaggtggaaggaaggaatctctctccgagctgtgagctacactgcctggggttgaggaaagagtaacacagcactcccttgactgcctagctggtctctcactgggttgcatgtactccaagtccactggctctgaatccagcatagcaccaggactgcagtcctagtggcctagactaccttcaggtttatttagaatgccagagaactttagcccacagtggtgggactagccaaaatttagattctgactgctagggtggatgattcccctctggctaggctggtctaaatgcttcctccatggacgccacctgaattctgccctctattgctttccttgtgatagggttgcactgaactctaatgcaaagtcccaagatcactgtgctctcctcccgcaagcatatacagattatctctctgggccaagaggctcctgctgggggatcagggagtggtggtgtagataatgcaacactgtctttcataccctctttagtgcctctttccttgatatgatgttaaaactaggtactctgctcacctcatttttgattcttataaaggagctttcttatgtggatagttattcagtttgttttttattctcgggaggatgatcactggagggttctatttgactgtcttgctctgccttctttcaagctgattctttctctcatgtctgctatctgtgacttgggggctcctttgtgaggcctctagctgcaactcccataccaggctgggtgttttccctggctgcccatccataccagccagcggtcttctatactctattgaatgcaggctctggctgtaaagtcgcctagcatctttaatgatattctcttggtcaacactttaatagtctgaggttgagtttctttcttgtagagttcatctttggaccacaagagacccacaggcatccttagttataatatctttcactgtatttgttttctcaggctgccataacaaactaccataaactgaatggcttaactaacagaaatttattttctcaatgcttcttgaaactagaaatccatgattagggcattggaagttttacttttaatggggcctctctctttggcatgcagatggctgccttcttactgtgccctcacatagttgtccccaggtctgtattgactgtgtcctaatctttcctttttataaggacaccagtcagattagattagagcccacccatgagaccttattttaccttagttacacccctctaaaggctctatgttcaaatacaattcttattctgaggtactgaggattaagacttcaatttatgaatttaggggaacagtattcaacctatatcacccacattatgacagaatgtattcccagaaacagcacaacccaccttggctcctctgccagagtgactcaccttcatcactcttactacctagatgtcatgggaaggaatctgactccagatcaccaagtcctccaaactcccaagagagacagctgaaatgcttccagtgatacccataaagtccttcttactaagctttaggtggaagaaataatgttctgtcttgctatgggagaggaaatgggactagcagttctcattccaaaaatcctccttataaaattctctcaccccactctcatattctaagcctgtgattttcaaccttagggatgccattgggattgagcaccaatgctcagaccctcagaagtacaactgtggtctggatcaaaagccttacattcctggaagcttgctagcaatgaagactctcaggtccagcatgagacctattgaatcaggttctacatttaacaagatcctcaagtgatatgtgtgcccattaaaatttgagaagtttgctgttatagactagtggttcctaaattttagtggacatcataatcatctggacagctttttaaaacacagaatgttaggccctatcttcagagttttcaattcagtacatctaggatggaccctgataatttgcacttctagtcaaatttcatggtgatgctgatgctactagtttgggaatcactctttgaaaccaccatgtgtagatactacactgtccaatactgcagccactatgcacatgttatagttatttgaaatgtgctttgcattgagatgtgctataagtaaaaaatatgcatcagatttcaaaaagacagtatgacaaggcagcatatcacatttatgattttttattgattatatgctgaaaggctagtatcttaatattgttgagttaaataaaacatattaaaattagttttactttttaatttttataatctgaatactagaaaatataaaattatatatatggttcacattatatttctgttgattggcaccgttcatcttgatctccatttggctcaggggtccctgaagtgtgtctaaagctgattcttgatcatttaccttgaaaatttattatttgctcttgtatcttactttaatatgctatatctgacaaatcttggcacctcagtgaaaattccagttttaacattccaggttacatgtataatattttggataatcttcatcaaatccataaataagacattattatctgcatttctccaaatgagaaacctaaatgaaaataacttacctaactttctctaactagcaagtaagatgcaaatatagatttgtctgccttccaagtccatgcttttccagttaaccatgcagccttcactctagcacagagatatgtggatgctcgatcttgtgaattttttgaaaactgtctgcttaagtatgtataactgcacctttgtaggagtttcatataaaagtaaatatatctagcagcagcttagtgtttaacaagacaatcatttcttcttaatggaggaatttaactagattgcaaatgttaccatctttaaggatggtgtaatcaagtaattgtgtttttgcatgtttttgtttctttgtttgttgtttacttagactcttgccaactcagactgttctcagacctggggcagcactggctatgttatattattattatatttataataattatttaatgtaagtatattcattctgtgtaactggatgctaactttgactctttcctctttgtttgtgccagacttctgaatagcccttttttctctgactttatgagtggtccagacacaagtaatagtgcagtgcaatagggagtatcaatgcaaaaattcttgaattctacattccaagttagctctccagagcaaattgactcaggccaaatacattttctctatgacactttctataacaaggtaggcagtatatttcctaagatattagattgtttctttttaaacttctaattaaatcacttagaaaaccatattgcagttgtccattgtatgtcaatatccctgattcaatggtaatcttgaggacacagattgtatattttttttaatctccagagacatgtaggcatgcaataaatggtctgccttggacttaccttacactaaaacccttgacactagaagtgggtgatttaaaaagaaacaaataaaaagtaaaaaataaataactcagagaaactctttaccttcattcatagttttcatttgactgttcaagaggaatatctaaggtcttatgatagtaaaattttcttattctttagaaagtctgactgtatctattttagaagccctatagtctatagtagtttttgataactatatgaattaatggatgaatgaatttccaaaaaattattgaaaactggatttttaaattaacatgagagaccagtaaacatttgtgtttgtttaaccaaaaaaaaaaaaaaattctattatctttgtcattttatgaaggacattctaaaaactaaagtatagaaaagatataatctcagaataaaaatcaaattttgaaaacataaatttatttttattttaaaattcaaggcactaccctatcacattccatggactctagttgttagttgtctgtggactattaggacagaaccgcttgtttgagatgcaaggtcagagtgtaaagggtgtgaagggcgatgggagagtctcatgattccctctcctttgtgcggcctctgttcactacacacagcaggagtgctttcgtagtcagctcacctatttgagctagttacccttttatctttggcttagtaaaactgccattatagaaagaggaaaaagccacaaacatttaagctgtaaaacgttagctcctcctttaatggaaagatgtgaaccaacatactttgtatatagggcaaggatcagagatactggaagattttaacaggcagagtaaccatagactttttgaaaggagaaaagtgttctataaccaccatgggtcacctgttgatcattcctcattagtaaagtcattatgtacttgccaagattaactgaatggaagcagaagtaaattcagatgtagataataccattacaggaggatatactttcttctaataggaaccaataaactctcatagtctttcaaaatgattcgtcacatgcctcaaatatttgcacaaaactggaaacataatttgcaactaattatttctctggatggatcctccatttataaaatgctagcaggagatctgcaaattctggcaaacataaaggctttgatggccatgaactacattaatataatattcaaagcaacaaagccaagacagaatgactaattatctaaatttcttctgcttttctctagttctatcccaataattgttttccaacatgatttacttcctctcatgcctcactgtatttattctcatacttccaacctcttcaaagcaagatggagctagtgatgactgatgatttgttacttttaacaattatgaaatttatttcctatcccacagcacaaaaaataccttgtctatttccctgcttttgctgtttagttttttatccagagaagcaaaactgaatatcctcccaaagtgcttcatgctcctgccaacacagaaaagttaatacagtttttaggtctaaaaattaaaaattaaaaacagtcttctctatctaacacactgggatctggtaaaaataaactgtaggaatcctagtgcactgagaaatgtcagcactctttcactttgccttctcttgtagtgggctttgttctctgttcctgacctcgtgcaatgctgtcctttgtttggcgtggcgcctagtttaccttttacttgatatagcttctctagcaatcacctttgattcaccagagatataaatctgcatttgtccttatcatggcctatttctagatctttgtgtatcttctttcctattcccaaacctagtcctggaccttgggacctcatcccaggcctcttccatcctacaaaagaagagtaagctcagagctgaacaaagttgaacaaagctaaactatttgccaaataaagttgttttgttttgttttgttttgttttaacagtacctcatttccaagtaaatcaatgtttgaagtaacagtgataatttgagataacttgagtcatttctttctttggagcctgttattcaaaattctctatcaaatagctctatgtaatatagtctgattttgttctgcctttcccataaggatggctacttacttgtccctcaactacttgattattacaattgcatgaaattttattccttactaagctctcttcatcaaacaaccaagcataccctcaccacaacatccacatgacctcagctatttctgagtgaatactgtagagcttgatttgtacagtatttatattattacaccattgtgaggaaaattgttaaaaccaagatttgtctcctgaactggactccaagtaccagaaagaaaataactatgtccctttgtctccagatgggttaaaaacccagcacatttctggatccttcctgataggaacataataaacattgaagtctggctttgtaaagaatcattagtctttctttgtaaagaatcattagtctctcttttcatatttacattttattatgagaacatatttctttttccccaggaacttaaagtactttaatttcttttgtaatttctttaagtataggcagggcaagataaaaacactttttttttaaacaacactagttaaataggcattcctttttccagtttttaatttttaggaatagataatgatacatatatgtgaggtacatttgatattttgatacaagcatacaatgtgtaacaaataagcctgggtaattgggatatccatcacccaaagcatttatcatttatttgggttgggaacattccaagtcttctcttctagctactttgaaagagataataaattattcttaacaatagttgtcttattgtgctactgaatgctggatcttattcgttgtaactgtatttttggacccattaaccaaaccttcttaatcccctcctcctcccttttcttcccagcctctggtaaccattgttctactctctacatccataaaatcatccctcctccttccttttcttctcagcctctaataaccattattctactctctacatccataaaataattttctttagctcccatttaagaatgagaacatgcgatatttgtccttgtatgcctggcttatgtcatttaacataatgtcctccagttccatccatgttcttattagtttattaaacaaaatttgtttgtagcctaatgagtaagaaaacactaaaacacattttaccaccaagaaaaataaaaacgaaaaggagctgtctatatcatgaaagtgtggattcacatacaaataaatgaagtatgtagtaaaaaaagtcactaagggaagatcagaattttattttctctattgaaaatgtggagacttggtttctgagcattatcatctgacttgtttgtcagcaagagagagatgtgctgctctattttgcatataatgacacttgatcagttgatatatcattgtgaaaaaggcaaagggcatcatgcattcactgacgtatatacagcatcaacaggtgttaataacaactattgcaaatgcttcatagaataacaaaaggagcatagatcagacaaggagtgtagatggtctgcaactgctcttttgagaaggattatgtctaacacaaagaattatttcattaccacttccagtactcttgaaaaacaacaacaaaagaatgtgaggtttagagactgattgattaaaccactctgaaaatgtgatttttaaaactgcagaagaggggaatgacataagatgaagaagagtatctctatagggagaaggaaggttaatatatgagtaagactaaaggaaacttggagaagtgagagaagaaccttttaaaacgaattcatgcaagaaggatttatataacttgctgtctatgtaaacatggctagccctcccattaaatcagtgggttccaaccttaaatgtatcttaaaatatccaggggaagatttgcaaaatactgatgcccagatcacaccctcagatattctgattcaattaaaatttcccagggttttatttattattattattattattatttgagacggagtctcactctgtcactatgctggagtgcagtggcatgatctcggctcactgcaacctctgcctcccgggttcaagggattctcctgcctcagcctcccaagtagctaggacttaattttttgtattttagtagagacggggtttcaccatgttggccaggatggtcttgatctcctgacctcgtgatctgcccaccttggcttcccaaagtgctgggattattaccagagttttaaattatctccagggttggcaaccatttcaatatgtaatttcaaaggagattttgttttgttcatattaggagagactagtcctcagtctttattcctataagataacaaaacactgagccacgttggcatctttgcatcatagtgcttgtccaacagagacacaaaacaactataccattcttctaaagctaatctcctatttctctcaaggaatagcctgaggtgtacttctggttgctctaaccaaaggcctcagaatgctcaggcttagagtttctacaaaagaatgataagtaatgcaactcctcttctccccagatgattttagaatataatcatcaccatagtcagatacctccattggccattttcccaatgatacctaatgacattcagagatagcttataattttgctcttttatgacaagaaaccaaagtagccctgtcatgtaccattataaaaaactactaattaatgacatggcatcatgtatattttcagtctgaagcccaaatgaatcactacgaaatctaaaattgaccttccctcattctttctcatattttcctctcccctaatcttccctctgaggaatgatagtgttatttatatcatctttctatctatttatctacacacctacctacctattatttatcccttctatctataatttttttcttatgaagacaacaaagttcataatagcaaatttggaaaattcagaaaaacaaaaagaatataaatcacctattgtggttctagccaatgataactaatattacttagttgtccatcttgttagtaatttaaaaatattaggatgatactatgtatataattttatatcatatacttttcatgtaacaaatatataaaaatatttttcaatgtaataaaagcttgatgcttataagactatctactgtagaaatatagtatacttcttgggcacatcatgggaagcattagatttaattttaattacataattattatgaattattttaggtctttgggtattttttaaaataagtggattgtatccttttccaaatttagttttagaaacacttgtacagatacacacacatactttctctctctctggatatacagataaatagatatccatcactgttaaactctttttgcagattatctcatttaatcctccaccaatcctttgagttaagcagttaagcattattatttttacagagtaaaaaataaaggttcagatcaaataaatttctaaagatcaggttcctctgacgttaatgttcaaaacattttcaccactctaccatattgtatcccagatattacagctaaggaaatttatcttgattttctccaacagtttcatataaatattttgaagcacagagtaaaggtgaagaattttctagtgagagtgagcactcctatccttaatatctatattttgccattaacacttttactgtatgagttttatcacatacctttgtttctactcatcttgatatccatccatttatctatattatttttatgtgtatcagtccttaatttttgagccctattataccactgcctaaactaagcaatggctatgataaatatattttggctgttttagttttgtttcttttttaacattttgttctttggtcataggtaggaatgatcaaacccaaataatattaaagatctagaaaatcacaaagttattttgcatcagtatcaccagtcattgatcttctaggaatagaaaaattaagaaatactatactgggtgaagtcaaaaatctgcttaaaaacactggggttgaaaatgtagtcattctactacttttaggtacagaggaaacaattttttgaagctatttaacactgatttgattttcctcatgattttagtcagatcccagaaggcagtgccactgctagtcctcatgatgcttttatgtatgtttgaaaaagtatccctgcctcaagatattgatttccctctgtcggaaaattgtcattatgaaggtacaagcctgcaatgtgaacatagcccgtcaggttgtggttcctgtgtagtacacaaccactgctgctgacttcagagatcctccgggaggttcctatagtggattcagtggatgatgtatatgccctgctgggcttgactctgtgacgctctggaggggatccttcccgtgagcctgctgcttaggtacctggctttgccccagcagctcctctggtgagcttctgagctgtgttcttcaaccagtttctcagaaaatccaggaatctaacctacaacatgagaatgaacaatggctcaaggggctactctctgcctgtggggtagccctcctctgctggagcagtcatagagcagtaatagagcagtaacactgccacttcagtaaagctgttttcttctaccctaccactaacttgtccttcagttctttcctgtgcaaagccaagaaaaaaacaaagtgggtcaatgaagctacatgccagagccttgtacctcaacatttcacattatgaggcttacatatgatatagctactaccatgaggtctttcattcaatggcctgaaacatagagctgaacacacagaatctcttgagataattttctaaaatgaggcaaaaaattacaatattggcatttctctttctctacgtttatttccctcctttgctgtactcttccacaattctcaggtatcataaagccttggctattcttttacttcttctatatcagctctttcttctttctgagtctggttgcagattaaacctgaggatgacagtgatgaggaaaagtttaatgtgagaattagccattgacggcttaaatggtgctaaagaatcttagaaaatcttcagtctctctctcttccaaaagtgtggtttaaggcagattatgttgctttaaagtcctattttgcataccaaaattaaatattaactctcctttttctctttacattgcttgtcaatttctcctacctttctttataccttggactaaagagaaagtcatgtgcttgtttaaatttccatgcaggtttaaataagctacccatctagattacattattatggttgcttaacaaatcactgtgccacaaatttagtggcatacaagaacacccagttattatctcatagttctatagaccaaaaatcagtgtgggttcaactgggttttctactcaggatgtcataagatatcatctgggctggccttaagcgggggctatggttaaaaaatctactttcaagctcattttagagaaaatgacttttaaatggctggtgtgattagattacactcagtgggataatctgccttttcattaactcaaagtcaactgattagtaactttaagtacatctacaaaatctttttgttacataaagtaatataatcaaggtgtgatatctcattatattcacagtcccagatattaggatacagaatcttggtggaccacttttagaattctgcctaaaataatttcttattttaaatcagaaagctaactcttgggatttctgtaactctttgtgtatagtaatcaaaatagtccttctcagagttcacagttacctgtgaggagattattctagtgataaaattgaatttatgcttttttaacttttattttaaaaataagaattttttatttgttgtatttaattatgagtgatattacaaagatcacatattttattaaaagaaaaaagcagcacaacataagaaaatggccaaactacttataaaatactagcttttaaatatttacttttttggtattctttatatatatgctttatccattatgaaatctggcatataattctaatgcatttaaaatatagaaaacatactgattttatttctttggaatattgttatatccattaggaagaaggtatgaaagaaataacactatattttgtgtaatttgtttattcattattccaaacatcacttggaccaccttcttctgagaatgttgaagtctagaaaatttaagccagattatgttgacgttttaccaaatccttgaggagcagaataatgttttgcaaagtgaggataagactacattgacatttgatgacaaaaaacttatgagaaataaaaaagtaaatttagaactagtgaaataaataccttgtttattcactacttggcttacataatttaatgaacagaaaaaaggtcaatgacccaaaaagaatagttcctatctgcactgaacaaatgctagaattatcctcttccaattactttctacaaagcttactatccaacgtcccaagcagtgctaacgaacaaagaaaccagaattaagcattcgtttatttaaaatatgtgaaaattcatgtacatgccaaaacatctatgtattgtatagacataactacaggatctcactagaggattttgagaaaagcaatgatattattggattaaggctctgctatatttatttaaaatatttatttgatttattcttattataaaactggtcagtgtgtattctgaacaataggaaaaaagatagaaaatttgaaagaaacaagtgattatacaggctctctcccaaaatattttactgtgactataatattagatgtgtttattctagactttctaagcaggtttttcagttttgatcatatatgtataggctgatgtattcacttaatattgtaacaagtatttttctatgttattacaatctcttcataaaatcagtttttccttattgattcttcatcttacatacattttataataaatattatctcacacttaattttctctgtgcttgagtgaatgtctttgtatctgagtgatttaattctttcatcatatgctaactcttcttcattaattttttttattcagctgcctcttgcctaatgctttcagttctagaaatcattgagatatgctatggcacaggttgtttatgtaaaattgagtgacaatgtttttataaaatagttttcccatttatttttgcaaaagctcttttgtactcattaaacatgcaaagatgatggatatgcatttatttatgtacctttgacagattgaaacatgcaagtgacagtgtttttcagctatttcatgacacaatcaatttgattccagaaaacaaatgccaaaaactgatgaattcttagcgaaaatttaggttagtgatttttaactttttcactgtagcctttggctacttaagtcactaattgcttcaacaaagataatactattatatatattcaggttatatccaactcaagtttacacttcagtagtctttcataaaagctatcctatctttaataccatcttttcggaataatgattctgtttagagattttccctactttgttggttcatcatagatttgatgctacagtttctcaacaacatacattaaattggagtttgccttcttttaatcacatttatttattttttatcttattcattaatctaattgggtcatgtatgagaagtttataaaaacaacttatcctcttcatcaatttcctctggattcattttgcatagagaggaaatcaaccataaaaattaattccagagtatataccagcttccggaattggagttgcatcaacacacacataagaaacatcagatggtctgggctagattgtttgattttgttgttatgtcattggctttgttttagttcctggaaaaaaatgaataagggatgactactcctttaagagcttcagattttcagaggtccttgcatatcgcctgcctatctattgccatggttctgttctccctgtgcacatcactgataagcaggagcagactggatgagagagggatagaggtgttgtaggaggaaggctctttgatttgcaagtagaaaaatagataggtcaaggatgagagtaagttggtagaaagttgaacctatatcagaaaaccaaaaacgtgtaagtagctatgaaacttaagtgataaacaatatatatgatattagcagagcatataatagatatacttactaattgacaagattttaattttatcaaattatatttcaaggacatatctaggaaacccttaggtgtagaaattccaacaaaaatgatgtatggtattatttcactatcataaaagtatgcatctgactcaagattggttttgtacaaatcaggcacattgtacatttcttcccctaggccatcctttccctaaatcccaagcattctcacctccagttggactgaaggtgtcaattcctggctagagtctggttttatgacttatgttatagaacataactcctcactctttaagggggagatgtgcttcgtgacctccttccaaagagtgctgtatggaaatgtgggaaagagtaacttcacagtagagaaacctgaaaaacaccacccgatcaaagtgagaaagttgagcattagtagtgataaattatgtctataatatatgcctttgttatgttgttatgagaatttttacctctgttgtcctcctccccaaactttataaccctagcttaatcatgagaaaaacatgagacaattctcagttgaatgacattctgcaaaatacctgaccaatactcaaagctgtgaaggtcattaaaaacaaggcaagtctgagaaattgtcagaccttagaggatctaagaagccatggcagctaaacatagtgtggcattgtagatgggatcctggaacaaaaacagaaattaaataaaatctaaggaaagctgcacgaagtatggacttcagtagataatttgtatatcaatattgattcattaatttcattgcaaatgtactctactaatataatattaaaaataggagataaaggaaaatttctctaactgtagattgtaggcattttaaaagacagtgccttgcacttcctttctctattttctgcatagaaatagtgaccctatgttatatatttctgcctaaaataacttgtaccatacaaagttaaatgtttaattctttcagaagaacgttgcattaatttctacccaactactccattgttcttctcttatgttcttgtttaccggctcttgattgcaattcttccttatattcagtgctgttggagtatccctctgacacatcttaatgaacagatttatggttgtctatctttctcaagaggttatcagcttttaactttgtctttaccatgtgtacttgaatcttgaatcattgtggttttggatgataactctgaatgcaagattctgaaataatacagtttaaaccaaacaatttaaattggcaagtgtttaaactctgtgctaaagagtgattatcacatgctgtttactttaaagctatatagagctttgtcttatacatgaattaaagcatttataaaacaaaataaattagaaaacagtgaatcagaagtacttgactaaaagcagcaaagtagcctcagaaggaatctgaacaaacttgacctagtgaggtataaagtacaaagatggttgaaattgagccaggagtgaagccctacctaccaggacatttaggttggaagatgtccatatctggagtttccttccatcagactcaacagatggacacggtaaaagttatgtgcgcatggtgtgtatgagagtatgtgtatgtgtgtgtgtataaactggacatgctgtagcatgtaaaaattgaattacttcttagaaatatttgcataatgcttttaaggcaatatgtttaactgatacacacttggaatggtgaaagtgtgaattagggacactgttccaaactatgaataaagtggtggtttcacccagcactagatccagatttgggagacaccttgagaattatctaatcagtcattaagttaacatcttttttttagagtttgttgtcatttatttaaagtggttacctcattttgtagttatcattacatccagacaataagggatgtggttgaatttcaaaagttttctaacttaacaagtcttattttgttagattatcctcacttaggtcttcatataaatttgtaactatttcttctgaagacatggagttttatttaaactactgtatttttgttttatcatagaacaacagaattcttattacagaagttgaaaatttttaatcactattggatattaactgaagttctgtttctaatcataatgatacatttaagtgcctacatgtggcatacatttctagattctttgagtaaaacatttgtatgacatcaacatctgtattgccatcaggagtgtcatttctactggcaggggcagccacctggaaacctgaaggaatcatctacccagaaaaagtgatagggcatatctgtggtactaatttttgctttatttctattgttcacagattggcttatacagccatttattcatttagaagttttctctgctaaggcaccttcctctcctatcgcaccactcaaaatttggcccatctttcggaactcagttgaaatgccattttgccattaagttgattgaaatcctctcaaatatttatgatctatcccttttcagaatgctagtaacttttttactcttttgacattctcttatgttgtgtcttgaatgacagttgttcctgtacagatcttagcactcttattagcctaccacgcctggaaagggctgtctgcccctttgtcatccttggcctcatctgacacacgacactatgccctccatgtgatgtcactgcctgtcaccttatgtttctatcctgcgttgtatactcacgttcttccatctcacttccctgctgtctcctgtctttctttagaactacattttcctctggtcctccttctttgagcatgtattatttttaatatgctccccatccatataatcctggctagcctctactcacttcttaaccacaacgctcatcactttaagggaagatatcttaaactgagagggtttggaataaagtggggaagtgggatttgtcaaacagaatgaaagcatgcatgcaggtgacagtcctgaatgtgcataaatgacattggaagaaagcagaaagacactggatggaaatgtgcaaatgaaagaagattccatggattgggagagcagagaagtgagaaatcatccttaagtgatgttcaagaagaacagaggagatgatattatctccaaatttacctgatcataagaagtatcttaccaacgtgttaagatgtagattcctgagacccgccacagtctagcaaattataatcccttgagacagcctgcaaatctgattttaagaagcttctcagtgatccctatgatatgaattttgagaaaacctggagaaattgatggtaatgtcacagaaacataaaatgttaagagaactggggatggagtagggataggaggtgggacaatttcttcctcttacaatacgggataattgggccaaaagcaggggtgcagggcagagtcctaatgcacaaagtgctttggcctccttaatgagcctgcattaactctgccagctgaaaatatttctcagtaaaatagggcaaaaggcttttacaataagattactaagattttgttaagtgtgtttgaccattaagggaaaaatgtgaaaagttgtgagatattttctactcctgaaacaatcatttcctattagcattttagtcataagtttacttcactagctcttatgttcttagtttcttcaacctactgcagaagaactgaaaacattattagagtaacatgatatgatgaaatcatgagatttcaatcagttttacaacagagctgaaaggtgatgttttagagactgtcaaattattttcagagactcacactagactatttcttactgaaaatatttaaatacagcagaatttaactcaaagttctataaaaagtacattttataatattggtattaaaatgtcttatatcagtactatataaaattgctgtttttgtttcagtctgaagactagtatagttagtgaggatgttaaaacttgacaagaattacataattcttacagatttaaattgatttctttcaactggacttatgcactggacttttcaaagagaaaagtatgaacaagggcaaattcatatttaaagggaacttttcattaaacactttgtagtctactctgtcatttttcctccaatgaggaattctatctttcgttcagtgcacacaaaaattaattgtaatcagcatttttgttgcctaatgtctcatgtagttaaattttttcttaaataaaaaataaatagtaatttgaaatttaaaatagcattttatggagaacagagtattaatgagccagcatgtaaaaatattttttcattttacaagaagcttatttaatttttaatattcaattccaaaaaatacaaagggataagcagaagcaaagtttggctgtgtgtattttataagtcacttactaaataaaacatttatttccagatattttctttagccacatattaatattcaacctagcctagtccctttgaaaattgttaacaactagattccttatttcatgtcctagtgatatgtaacagtaaaatgtgatttttactcaatgcataagtgagagatcctttgtttatttaatattttcatcatttccttgagtaaaaatgataaatatattatttaccaagaaaagataaaaagttctagctgactcttggcatgacatagactgtgtgatacaatccagttgtctcatgaggaatcaaagaagcctagagatctgttacagttgttactaaatatcctttaactggttctgtcctaattcaaagtattttcatgtactgcatgacacaaacaaacaaggtagagaatttttctgaatgtaatacaaaagtcagggtgtctcatttgaggaaagatgcactgttagcatttattttatctttaagcaaggtaataatttataattatgactgattcacatataatctgcagcaataacaaatcattaagcaatgaattgtgaaaggtaatgtcctagtaatttggttatttcagtacatcaggtgtttacttattcattttaactgtttcccaaattttgatatagttgtcaaataaaaccaaatgattgtaaggtatacaaggtgatgatttgatatacatatatttcgtgaattaatcaaattagtttacatgttttgcctcactgtgctgtatattagatcccctgaacatatttatcttccaactgaaagtttgtactctttgaccatctccctttttttcctgctcactgcctctgatagccaccattctactgtctgtttcaatgagtataacgtgtttagattccacatttaagtgagatcatgcagtatttgtctttctctgtatgacttatttcacttaggacagtgccttcacatttcactcatgttgttgcaaatggcaagatttctttcttttttatggcatcatatatatgacatttatatatatagagagatatcatatatgatatatattatatgccacaatatatattcatatatagaataatatatctaatataatatatgtatagtgatccaaaagataggtccaaattttatataatcatataataaatgtacaatctataattatatataatgtatagtataatataatatataatattatatatattattcaggggtggggatggggttggaatgatgttggtcaaagatacacaatttcagatagcaggagtaagtttaagaactctattgtacaacatggtgactatattatattatacaatatatatattatattctagaaaatgccaagaaagtggatgtaaagtgttctcaccacaaaaggaaccatgggagataatgcacatgctaattagctatatttattcttactgaaaaaataactgtgaagtaacatatatgttagttagctatatttagtcatttcacaatgaatatattcttttttttcctttccttttcttttttttttaaaagctaaatgaaagattttattagtcttgggaaaaaagacagaaacacaataaaaacttctctagtatgaacatgtgcaagtttcacaatcatgctattacattttgcactggcagacagttcaaggcgtagttatctgtcagcctgtgtcagatagcttggtagccagcagcagtcttttgaaaacacaaccaataaaaataccagatctaagcccaaggctaaactgacacagaggtcttctgaaaccaaattatggtagaaaatatgaagatgaggctttgataattcaaagcaagactcaccattataaaactgtatgatgattagggctaaatagttactttcatttaaataaaaatattaatacactgttatgtcagataatcttatagtattgagaattgaaatgcctgtcatgtacatgatgaagatatatgtaatggaataaatttgtagggttttttgggcattttgaaagtgtattttgtattattattgtccttttcttatcacaataaatatattcttaaaagcatcatgttatacagaatacatacaattttgtcaattaaaaatttttaaattaaattaaatattttaaaacataaaaatcaaatgacccttagatgttgaaacaatgaatcataaatgcccaactcatttaatcaaaaccacttttttgtaatgtattatatatttagatatataaaatgtgtgagtaatattataacacatatatttttaacattgagatcaaaaactaaaacactgttaaactaataaaaagtacaaatacagtaatatatttaaatttaaagaacttttaagcaactattggatgaaagatttgtgagtacaatttatagatgggcactaatgtttgcatttagtgcttaatttagttaagctagaaataaaatatagatttattgatactcacattgaaaaatagttaaaaatttttgagaaattcacatacaaaacctaatcctttaaacctcatatattttcccacaataacatgcttgcatttttcttgcttttcttattattgaatattgactatgtttaggtcctgttttaagcagtttacatgcagtgtatgttgtctcatttatctataacaagccaattaaatagatagcaattttcatggaaatactgtctaaatgacaaaagttatgttatgaaaggtggcattcttttttataactactagagaagggggtggaatgtagtcattttatctactatcatgttatttacctctaattgacaattttcacagatttaaaagcccttatatggtatttaaggacttaaatcagctatagtcttcttatctcatgttgaatagtatcttcaagctggctctataaataataagtgaatggatgagaaaaaaaggaagtgaaccaaatatgttaatggaaaaaatgttaacaaaaaatagaggattaatgaattcaacaactcttaaaaatcaactgttcaaactactttctatgtaagtacaatttgagtctattgtgatagagaagtaaactcaattcttgaatgtgatttcagtataactctgaaggagtctgcaatggtgattaaaggcagttattgcacaaggttaccaattacatttgttttcacacagctatatactttttttttttttcaaaatccttaccaattttcagaggaaagggttacggtaagctaatgtaccactagatccctttcagtttcattttcagagtgatagtaattgtttcatatgtgggaaggttttctgagactataatagtacatgcgtgattttgtgtgatttattcagaggctcatcagcttctttaggaggcagcaatgtaacagttctccagaggagacagtgccatagtgaaatatgggactaaggcactgcagatttagcccagacccttgactctgaaaagtcagaataatacatttagttgttttgctggacattgtgtaaatattttggaagagtgtgctttattttgctaagttcagaatgcacagtgggataatgtgtgatctggaacttgcccaatgtatgtaagagctgaggcacatcaacagagaggagatattggcaaaccttttacttgcagttcctagaaactgaagagctatgtaaccagaatatagaattactttcaatcataatattttagtatgagaatgagtcatttagcatcaactctttcaatttattgatgaagaaactaaggctcaaagaaattaagtgacttgctggaaattattactaaatggatgccagaatcagaatgaaatcaaaatgttcagattcaaagccaagtgctcttctgagtgcctcgtgctgcctcttacattagactacttctgacccacagattacattcaatttttcgacttataaatagtgttctcttttcatagccacaacatgaatcatacaggtgaaaacccatgcctttatggtaccacttcctttattatgtcaattatgtttaaaagtggtaaaatctagcctgtttgtgagtgccatagtttcaggaagagtagttttgtataggcattcttaaaacaaactttcatgcataattgtttatttaaattaaaaagtatgtaacaaaaagagaggagttttgcagtataatgtgaaaatgtgatcctgaatgagcaaaaaaaaaaaaaaaaaagggaaattacagcaggtcagattttatttttattgtgggcaaggactggtggacttggcactggtaatatctggttagagattttaaaatgtattcaaaaaagcaaatcaatgaaaattaaacaatctataaataatacttagccatcataattaaaacagctaccattataagacagacctatataagaaagggtgattttttttttgtttcccatctgactttggctatatcttttcagaaaatactttgtaaactttggaatctcatgaataatttagttattcatataaagtatgatcataaaaattaagaggatgcatatagaacagttgaattacttacacagggaatgtgactttattttatgaagctgtgggtcttgttgatttaaatagtttctggggttttttttgttcctggttgaaagattatgttgtattatgttaggctataattgtgttattcataggaatgaattgtataattatagtgtggtgacggcatgcaggtaaccatgactactactgttcttccatcaatttttgcttctttatgcagtggtgaatatttttagtggttctattatttgctcttttaaaacttagaaccaaaattataagtcatctctattaaaaaaaagtcttgcataattttacagggtcctccttttagatacttaggtatggaatatcaaaaaggaagctcatggaaagagatttctaatttaaacaaaaatgtgtatcagtggggccaccatcttcatttttctgactgtaatatttgcatttctggacatttttttctagccttcttctctgtgtaatcattaattcttggctatattttgtgtatcagatttctgaaaacttcctcttctgtttcattcacacaaacactattattgtttaggccttcaccactcatacttggattattaaagtaccattctgagtggccttcattttattcttaacagtatctatcctgggcttcatcttttcttactaatccttttggcttgactgcattctaaagtaatataaaactcacaaaaactcatcacaaaactgttccaaagctaaacatttattctttcagagactgtagatctcaaagtgaatataaaaatatttattctgtaaggagcattattttctttacagacactccaactgatgggttacaaggttacaaagcactgagtgtcagaagccttggaggctttttaggctacatagcagtgtatatcacagagaacatcacagattttgttgttgttgttgttccttttatagttatgaagtctactgcaagcagaatcacaaggtcaaggtcaaaggttatagaacatttttaatactactgtgtatgtagatggaaatacaaataagttatagctgctaattttgatgcaccaattttttattctctggtaacataaattacttgagataataaaattattcattattgaaacttcatattgaggtaaaattattctgttattgcagttgtagaatgttcccttcattacatgaaaactactcttacaaatcctagatccacttattgactctgatagcagagttatgacaaaatctgataatcaatagttatagcaaatagctcagtctttacttgcatatctcaaaaagcagaagtgtttccaaacacaacactaataaaattctctttccttctcacctctgtcattacattgcagaccttccacactccttagaaacttattctttcaccagctctaagtgatttttctccttttctacaccagattctttattatgtaaacataagtggcagttctctacaagacataattagtctttaatttacagaagaaaggagaagatgggactagatactctggctggatggaaaaggtgtggatatctatgaacaatctccagttaattcttttcaatcacaaaaataatggtttttgtaattagatttttgaaaacaatttttatgggaatatatatatcatgcaacagtatagctgactgtgctggaatttggtaacaaaacctttacatttaaacaggtctcaaagcaagggcattttttttctaggtaaaataatggcttttattttcactacaaaatcctttttaatctctcagattataatccagagacatctcaattgtcttcctccattaaaaaaatcttttagaccaatattttccctctgcttaattccatgtatttggaaggtaataacaatatcgtgcctcttatcatagatgggagaatttatcaatccatttttaaaacacctcatattttatctgttcacaattgtaaaggcattcagaagaatgtgcagtgacattatacaaaccagtcttgaaacctcatttatatcatgcattgtgaagaatgattatgttttgtttgtctgattttcaatcttgtatggagtaaaactttgaaaaatataacaaaaattagataaaataatagttattatatttatcatattaataatttaaagtatagcacaattgatgtggttagatgccatggccatattaaagtttttaaagctactttcaatgtcagtacatattcacttaagaggtaagacatagttctaataaatagttctctcaccagcaaacactgttaacagagacttcacaaggaggcatattttcaggagaggcttctccagactattcaactcacctgagctcctctgcaaatgtagattaatttttttttcttaactgatcacattattattttcttagggtgctaacaatgtcaccacaggccattgagcacttctttgtggactgacagaaggtgttccttcttcatgacagggtcaatactgcactgggcaggtggcttgaccagcagatgaagtgcgtgttggcctccatcgtcttccaactgtgtgcttctgggctgggacacgaccttcagcactatatgcagcagctgtcttacctggtccctctttctgatttcaatgcctaagtttcctttaattcattctcagcctccactgcagaggaaagcttggcagtctttgggcacaagaagttgcatataatggatgaggaatgacgttttaaaattagatttcataaagaatctagaggaggcatctcttactacctacgctaaatgagattccatctcttaattacattttacaaaacataagaggcattttacaaaatgtttacaaagtgtatcttctcgttaagctagtttatgtttctatttaatccagctcacaaggttagggtgagtataggattgggttttccgggttcaggaaacacttcaaaggaaatcatactttgaacatgttatctaaagttatccatgattttatatatatatatatatatatatatatatatatatatatgtcaacctaatataatacatataattatatataatataatatatctattataattatatataatatatatttatctattataattatatataatatatatttatatattataattatatatgattatatatatttataaatatatatatttttgtaaaaagctttgaagtatttataaaaagcagctgtatagaagcaaataattattcactgtcttatgttgacagcatggaacaaaaggcaaaatcatgactcatgaaactataaggtgaatatatgtcaaatcttttatttaactcattaattaataagagattcagtaaaatcttaggaccagctcaaaggaaacatttaaagaacataggcttccattaagtggaaataagtttgttaatatatgcaaaattagttaataacctataaagtaataaaatgtcagttttctagaaaaggaaaaccaattatatctcaatttatcagatgtaatttatttgcatttctatgaacaataattattctcatgacaatcagtcttgtgcaagttaacttctacttttacattagtctagataatagaaaatcggttaaagttattcatccctattgaattagataatccccagatagtctatcagacagcttctaccactttgttgaaatgatgcccagtaatttcatttgctgatttccaaatcttagacatttttcttgacacacccaaatatattgcatcagacaaccagtctctaaagttaaaaaaaaatcacagtttctatgtattttttcattacacaaaaaaccaaacagattcttgaagtcctactctgaatcatataaagttaatctgtgagcacccaaaaaaaacagactatcctcagtatgctcgccatttcactgagaatttcattgatgagccttgttttctccacagatactacatctgcccatgctactaagtctcagatcaattctgagaaagacaaagagctgtattgatctaacaaacacatattattgccacacatttcttaccaggtctttcctgatgcttataacattcccccaacactgtccctcaatcactcactgattccagcacagttcatgcagctggtggcagacttggttctctctcattagcttccaatatctcccactctccacattctcaccattatgagaataccttacccctacttaagaagaaatattgagaccatctggcatgatatcccgcctttattcccatctttcactcagagcactgctcatagaatcctaccaaaaaggaaaagctttcctttcactttcaagtagacccttacactctatctgctcccatctccttgaatgtagcccatgtttagcccctctgtcttaagtaactttcatttttcttttccagtgatgttttccttgttacccttgaacatgttcaggtttctctcatgctcgacatttttacctagattagctacccttctcactgtgatacagggtcatatacctgccagactcctggatcatgagtatcctaatttgctgcttccacaaggtacttgcccattttatcattaaatttctggatttgaggtccacatttgcttgacatgtgactaaaattctgttttcaaaggttatcctttggtctcagaattcttctgcaatttttgacattttgattttcacttttcttcttttatctataacacagcactttcttggttctctgacttctttatcactttcttaatctatttactaaaacatttatctgttatcctttattcttgatttctaatcattctcaatatgtgatccatagtcataatttcattgtttcaattattgaatcaaatatatgtatccactctcaatcttctcaatttcaatcacataattccatttgctcacaagataaatattttcttagggaaatttaatacctgtcaaattgaaaacactatatatcttgacaatggagcttctttcgtgtcaacctaattttaattgatgtgcaatggactgaatgtttatgtgtcccctcaagttcaaatttgaaatcttaacccccagagtgatggtattaggagaaggtggggcatttgaaaagtgatgagggcatgaaggcagagcttttatgagttagatcagtgcccttataaaagaggcctcaaagagatccctaatctcttccaccatgtgaggacacagggagaagatgctgtttatgaaccagaaagtgggacctcatcaaacaccaaatctactggcaacttcctcttggacttcccagcctccagaactgtgaactgtgagaaataaatgtctgttgttaataagccacagtgttatactattctatggtgttttgttatagaagctgaaatgaactaaggcagtgttaacacatctttccaaatcccatgggagagaagaatgtcttttaattccctatacacatttttactaaatctcattttccattatttcctcagctctaaatctatcaccaaattcttttattaagtttatatttactattttttatatctattattgtatatacatatgttatttcccatctagattataagccacctaaacaaaaggactgtttctcttatcttttcttggacctttggaacaattactgaataataaaagataataatactaataatacattgcgaagccttacctttttcaagtgacattaacatttatttttaaatttaatttcataactgacactcagagaagtcaaagaggcattgctataggattcacagcctataagggacagaaacggaaccaggaattgtttctaggatacttcttcattacagtattgattaagtggctggtcaacaaaatgatataaagtggggaaaaaagtaacccatatttacccgttaaagttgattgttactcattcttagtagagaggttctctctttctctctgtctcttttacttctggtatttaggtaacatgaaatttccttggagggttcctaaagcaagtaaaaatttagaaacttgagaagcttccatactaactgggtaacaacaatttgctcactgaaaatagtttcaataaaagcacttaatgggtttttttgcactactcagaaaggcaaatctttctgtattatttactttgttttcccacccaaaacaataaaagtagatatttttgatgtaaagagttacatgttgtaaagctctctcttttaagggctgcatttcttttctaccattataaagcaaacattattttgtgtttcaaaccagaatctaaggctgtggaaaagtcagataaaatttagtgtttcaaatgttatgttggaacatgtttctcctataaaatcctagagtttgattgctgtgttcctacacaggaaaagtccacaatgttctgttgtaaagagttaatttattattgggcaaaagtttttgattgactccaaataaaattatgtattagtccattctcatgctgctatgaagaaataccagagactgggtaatttgtaaagaaaagagattcaattgactcagagttctccatggctggggaggcctcaggaaacttacaatcatggcagaaggcacctcttcacatggtggcaggagggagaatgagtggagaatgagtgcaagcaggggaaatgtcagacacttatagaactatcagatcttgtgagactcacccattatcatgctaacagcatggggaaaacccttcccatgatccaattacctccacctggtcctgcccttgacacatgggaatcattacaattcaagatgaggtttgggtggggacacagagccaaaccatatcattctgcccctggcaccttccatatctcatgtcctcacatttcaaaacacaatggtgccctacaaacagtacccgaaagtcttaacttattccagcattaacccaaaagtccaggttaaatgtctcatctgagacaaggaagtcttttccacctatgaacctgtaaaatcaaaagcaagttagttgcttcctagatacaatagagatacaggcattgggtaaatacagctgttccaaatgggagcaattggctaaaataaagggctacagattccatgcaactccacaacccaatagggcagtcagtaaaccttaaagttccaaaatgatctcctttgacttcatgtctctcatgcaggtcacactgatgaaataagtgggctcctatggccttggggagctctgcccctatgtctttgagagtacagcccccctcgcagcttttatgggctggctttgactgtctgtagctttactaggtgcacagtgcaagctgttggtggatctattgttttgggatctggattatggtgggcctcttcgcacagctccactcagtagtgctccagtggggacactgtgggggatcaaaccctacattttccctctgcagtgccctagaagaggttctcaatgagggctctacccctgcagcaaacttctgactgaatatccaagcatttccgtacatcctctgaaagctaggcagtggctcccaaacctcaattcttgacttctgtgtactcacactttcaataacatgtttaagccaccgaagtttggggcttgcgctctctgaggcaatggcctgagctgtaccttgacccttctagccatggctgggacacaggacaccaagtcctaagactgcataaagctgaaaggccctgggccctggccacaaaaccattttttcctcctaatcatcagggcctgtgataggaggggctgccgtgaagacttctgccgtgccacagagacattttccccattgtcttggtgatcaacatttggcctctcatcactcatgcaaatttctgcagactgcttgaatttctcctcagaaaatggatttttcttttctattgcatcattaggctacaaattttccaaagttttatgctctgctttccttttaaacattccaagccatctcactcaagttcaaaattccataaatctctagtacaggggcaagaggccatcagtctttttgctaaagcataacaagggtgacctttgctccacttcccaagaagttcctcattgtcttcttgagaccacctcatcctgaacttcattgtccatatcactatcagcgttttggtcaaagccattcaacaagtctctaggaagttccaaactttcccatattttcttgtcttattctgagccctctaaactgttcaaacctctgcctgttacccagttctgaagtcacttccacatttttgggtatttttacagccaacgccccactactcccagtaccaattttctgtattaatctgttctcatgctgctatgaataaatacgcaagactgggtaatttataaagaaaagaggtttaattgattcacagttccttatggctgggtagccctcaggaaacttaacaatcatggcagaaggcacatcttcccaggatggcaggagagagaatgaatgcaagcaggggaaatgccagacacttataaaaccatcagatctcatgagactcactcatcatcatgatgacaccataggggaaccgcccccaagatccaattacctccacctggtcctgcccttgacacatggaaattattacaattcaaggtgagatttgggtagggacacagagccaaaccatatcaagttatttcaatattttgtcctgaaagtggtaagattttatcagagaaaggtaattttaaataagccatgctcctgcgagcagttaagagagaagaaacatatgagaattagaaagctagtactcactataaaaaaaaatctagttaatgaatatacttcactt

SEQ ID NO: 191 - DNA, 6499 bp, Homo sapiens
gtgacctctagaatcttaactgagttatcctacagtatgaaaatagataggatgtgggcggttccactttgcctttggctgttataactctcttggagcaagatgttctgcaaaaatttctgaaatgattctttcattgatgtaaacatggggacatccatttggaggacattctggcacttctactttctatctcccctgggcatcccatagggaagctcaaacaatgggggatgatgttatgagtttacactctaagaaaacagtgccctcccaagaagtcctcttcaggccgtgcacagtgactcatggctcatgcctgtaatcctagcactttgggaggctgagacaggcagctcacttgaggtcaggagtttgagaccagcctagccaacatggtgaaaccccgtctctactaaaaatacaaaaattagccaggcatggtggcatgcctgtaatcccagctacctgggaggctgaatcaggagactcactcgaacccaagaggtggaggttgcagtgagctgagattgtacaactacactccagcctgggggacaagtgcaaaactccatcaaaaaaaaataaaaaataaaaaatgaaaagaagtcctattctataaaatcagtgcagctaccagaaccatgggtgtcagatgtgcacatccagcagaaggcagtcttgcactccaaaggcactgactgtgggcccccagttcacgcactcaatacaatgggcttggctcttggagtggaagtaactgaatgccttcttagttgtttaagttttagcagcttaagcttttgctttttgtgggcttagcagttggttgacagagtagttgcctcggctctgataggttttacttctttcttcatgcttcgctgtgggagcagacaagtggcagagcagcaatgatgagagtggaccagcgctgcagacatgtaaccactgaataaaccaaaaatcaagagcctcttggtgacatgcacatgagcgactcgatgtctggatccttggcactgcgtatgggagatgaagtgctttcagtttgctcattagttgatttcagatgtttattcttatacagatcttatgtggacactacatccaaaacaacatatttacaaacttttttttttttaaggaaagcacttatatcacattcccagtaggtacacaagtgtatgttcatgcattgaagtgaaaatttcttagatcactgctaacctttgctacatgaaatgactctgatatattaaatttcattttgatttctatttcattaaaaactatagttgatacctataaaattgacttcacaatgcactattgggtcaaaatttccagtttgaaaaacagtgtgcctagacagtctggtgaagttcagtttccaaactaatcatccgcaggtctcctagttcctcaaatgcacatcttctgactcctttaggggtttcctatcctctagtgttgatgtcttcctggggcagccctctattctgctcttgattgaatttcctctccgatatcacctgcttgcctggctatgatgatcattgctgctgtagtgattcataaatgtatattcctaactgtggttgcgttcctgaattctgtatgatgtttccagcagcattccaaacagtttcatgtagccttctgttgtacccttcatcttgaactcagcaccaaaatcaaaatcattattttgtctaaacactgcaacttctcttcttagtctattaatggctctcttattcccctatctacctagcctaactattccaggccatcactgactcttcactctccttcaccctccgcagctcacctttcctcagctctcgttaattttttgctcacaacttctctctcacttttccattttgacaccacatcatctcaatttaaaaaaccaaatggcttctcattacctacagagttgaatgttaactctttagaatattggactttggcctcaaatcttatctccatcattgccctaaatgtgccctttgctgcactaaacattgatctcctacttatgccctaggaagaaataaatattttctagtttctcaggaataagcctcaatttttttgatgaatgtgacacttatcatgcatttccagctatataatgtcactgtttggattaatatttatttaggttagcatattattaggtactttctagagagttgtgatctgggagtcaccttgaattgctctctcaacatcgaaagggtaactaagccatactgatactgtcccctaaaccaattatcctaaaactttcatgtgcatataaattatctgttagaataaagattcttattcagcaggccagggatgtggtttgagattctgcgtttctatctggctttcagaaaatgtgaggctgctggttagagacccacactttgagtagcaagattcaaatgtggctttaacccatcccttcttcctccatgccactttttgggtttaagaccttattattacttattctcctgactggtctatttgccacctgtccctccccaccactagtctgtctcataaaaccattatctaatggatcattacttcatttgtgaacttcctaaaacaaaagtgcaatggaaattagaaatgcgatccttagagacctggcctctgaactaggattgggttaggcgccttgcttgggacatccttattctattcctgtttctgtggtttccttcttctctgctcattcattttgatgaaattaattaggctgttctgcttttcccaaaacactgattttctttttgccccagcccaagccaggccccatatactatggcacctggatttttcacacaacttgaattttcagaaacaccttccatgtgttccgttttcaatccactgttgtgaaaactctgtgggattcaacaacagtgggattgaagaagctgaaagttgataagaggaaaaccgtttgaaggataaatgaagtagtccatccatgaaagctagcctcgccctcttttaactgccctatggtcattttggtctccctgagtgggggtgtcatcccagttgtgggtttgcacaggggcctgtgaatttcaggcttttgctcttgtggaactgccttgtaggttatggggagcaatgctttcacatgtactgcttttctactgtattttactttatatttattctttcatttatcttcctttttactgctggctctgttgttcagtattagctaatatattgcaaagtgagctttcattgaccaggcagaggccagggtagggccactgagagattctggagaacaacagatggggaggaagcagaggtgtgcagcgagattcctgggattgggatcccagctctgctgacatgtctgtacagtcttggaagtgtgatctagcctctttggcctgttcctccaatcctgagagaggtggtggaaacagatcactgcttagcaggccttagggataagttactagggccacacagaatcttctatttttttaaaaaagcaaacacaactctcctccctataattatactacactgccctcaatgccagtgaagttttcctttgccctgtaggtagatttttgtgtgaccttctcagaagcaggaaacagattgaaaagccactaagatgtgggtcaaaaagtatttttcattctcatatgtgtccctttgttgcaaagactgtgacattcctccatggcagaaaggaatgaatttggaagaaaaatcccaacataactattttccaccctaaggaaacagcctctctttgcaatgtgtgaatgcattttccactgcatccccaggggtatgagtgtttcaagaagtttgcactgtgctgctacattcactaagcccccaagccccactccttcccagaccatcctccagagtccctgcaagtttccagaaacaaacaaatcaagagactgacaagagctctgcctggtatgaataatagaaaaatgagccactctgtgcaaggaagttggtggaaggtgggaggcaagcaggggagagaaagagattttcagcagcagaggggacctcagagacccatctacaagacggacacttcgctcagcgttatttctgcatttatgcctctttaatggtcagcggggcaatcaatagattgcctgctacctggttaatcatgggtctgttatggggtggcaatgggcatgctggctgtgggatccatgtgctgagaaaaagaccattgaatgttgactgttacttttctttctctttccccagggcagccactgaagttttggcagcattgctgaaatccagtaagcacctcttttgaagggtggctatttctctccactctgggtttaatgaaagatactttctggtccccatggctgtttctttttttttttttttcatgaactactatttctcaatcacctatggctaattcctgaccttgaaagtgataaagtcatgtcgtgggtctttgggggtaagatagagaatattatggctgttccaggtacatgaccacaaagagaaaataaatattatccatacacaatgccaccaagacaatggaccctaaagggggtatattgactactgtggagctgatggaccctccacccctgtctaacagagccagcagtccctaaagattgttgaaataaattccaggttccagtgggattgcctccaggtcccagtggaagaaaagattttggctggctggagagaagtattcctgtatttggttctcaactcagctcagctcatgagtctatattcttgggcaggtggagtgctgggaattgcttggacaatgatgatgctgataacaaatttatatttaaaagttgactcttttctcagttacttgagtgattgcaaaagaatagctctggggttctgaataatttgaggaattttttgcctggtagccctggcctaattacgttgggagtcaatttcatgtgtgcaatataatagcaggcacaatgcacttgggagggaagaagtcttagcttaatgtttttactcattttttcctccttacctcttcatctattttaatttggcaccttggaagccagctgcttcaattgtgatatttgtttctctatagggagcctgaggcctgtgggtaataggtgaactttaataaaacttttaaataaataaataaaaataaaaacactctctccccccatccatacatctctgtcaactataagcagagagaaagagccaaatcacatgctgtttccctttataggcttagaaaaattgaagcttgaattcatttggtttatttgaatttgatatgagatgcaagtccacatctgtggacttgacatgagataagcttgataagctgtgatatgagataacttgagataacttgataagctgtgatatgagatccacagcttaaagacctgcaggtagagtggaggtggtaagagcaggataggggagtgaagaggaagggcttatgaagccctggagataggaagggatggaaaagtgttactgtgggttctggggagaggaccattcattcttcagactgaacttgcttcaggtttggcatctcggttctcattatttatctgctccctcggttgctcccaaatgcctggtgtttgaagcaccaaggtgagggggtgttgaattgcaggaggaaaagatgctgagagcagcctggtaggccagcctgtgaatgtcatgccttgggaaagaagctatctctcaaatccccccagcccagccttggcatggaggacttgatgtttcatgggaagggagcccagagagctgagtaaggctggcttactttctacatacacactttccttagctcttgagcttacggttgagcatcctgatataaattgtacctacctagatgtgtaaaactctgaaagtagtcttatgtcagttgtttactctattgatcaggaacacaatgcctcagcccaggaaaaaccaatagccagtgcaaacacggcttgattcaggctcagaccgtgtagctaggttttcaacacaccagccatgcctagtaggctgagtgtgcagtgatgggcctcagcttttagaatttctaacttcttctttccctttagagcttagctcagatattgcctcctctgaaaatcctttctctgactaccacaacttggatgcccctcaccaatgcttttataggctctcccaactcagacttgattacattgtgatgaaattgctattgtctgtctcttccagcagactgcaagcttttgagggagagagtcatctgtattggttgttgtattacttgcctcagcacaatgaaaatcctgaaataagtatttgttgactaaattttttttgttgttgttttctttttaaaataattttgagtactgggataccaaatttttaaatgaatacatgatttgtgatttttcccatgtgtaaaaatggcagtactgcc

SEQ ID NO: 192 - DNA, 6113 bp, Homo sapiens
tcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaa

SEQ ID NO: 193 - DNA, 14746 bp, Homo sapiens
aatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctataaattaggaaataattaccttaatccattaaatatagaaaaagataaacacattcaaaattaggtaaatgcacagcaaagtgacgagataccttttttcacctatcatcaactaggatcaataagtggataatatgtcaatgagggtgcaggggaaaagactttctcatacatatgctttttgtagaagcataatctggtacaaactatttggaaagtaattggtccatatttacaaaatttagaattcacatgcccttggatgagcaattttacttctaggaatataatctgcaattatgttcatatatatgcaaatatgtatgtctggaaaccacctaaatatccatcaatgacatattagtaaatgaattatggaacatctacaggatgttaaagcatggcatcattacaaagagtacattatatcaatatgtgctaagatggaaggatctcctccatatattgttaaatgaaagtatgctcccattgtgtgtacatagaatatttcaggaaggaatatctccctcctaggggagaaagactggtgatagaaagtgtggtgtaggaggaagacttccttttctctgatgcccttctttagtgtctacatttgttaatatggtttggtattactttttctacaaaataaattagttttaaaacatatgtcaagatttctgattccaaggggaaaaatcagataacatgagtttcctgttgtgatacagaatgggaaacgctacattaccaatgatgtacaccagccagaagtgcctgggggaatctaatcaagcctttagatttcacttccagttcagtgaaatcaagggatataggaacaaggtaaacaccacaatcaggtgaatcctatattctacaggctggctggcctggtcttttccacaggtcattgtgttggagttgctcatctttatatgacaaaccaatgcaatgcatggtcctggttgagacaaactggctataagaggtcttttgggaacaactgggcaaatttgactaaggaatcaggttaattttggcaatgcaggaaaatgttcttaatttctggaaataatgcaattttttaaaatgcatactaaatgttgattactatttataatttatgctaaatattttagaatataaaaaggaggcgtttttaaaaggcaagatttccacaggttttgattttgtagggggaaattaaggagaaggtaattgtctgccaaaaaaaaacagtgcaattaagaaaaactggcttgaactagctctttccagttctacagcagatgtttgctgtactggagttatcaagaagagcagatggccctctgataaaccctgctgtgcatagactcagcaatgcagaccagcaaatagctggcatggaaaccaactgaaagggatcgaagagatttgttgaaactaggggcgagggtcagctggaaaaacaattcctgctttgcaatgatca

SEQ ID NO: 194 - DNA, 16475 bp, Homo sapiens
aatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctataaattaggaaataattaccttaatccattaaatatagaaaaagataaacacattcaaaattaggtaaatgcacagcaaagtgacgagataccttttttcacctatcatcaactaggatcaataagtggataatatgtcaatgagggtgcaggggaaaagactttctcatacatatgctttttgtagaagcataatctggtacaaactatttggaaagtaattggtccatatttacaaaatttagaattcacatgcccttggatgagcaattttacttctaggaatataatctgcaattatgttcatatatatgcaaatatgtatgtctggaaaccacctaaatatccatcaatgacatattagtaaatgaattatggaacatctacaggatgttaaagcatggcatcattacaaagagtacattatatcaatatgtgctaagatggaaggatctcctccatatattgttaaatgaaagtatgctcccattgtgtgtacatagaatatttcaggaaggaatatctccctcctaggggagaaagactggtgatagaaagtgtggtgtaggaggaagacttccttttctctgatgcccttctttagtgtctacatttgttaatatggtttggtattactttttctacaaaataaattagttttaaaacatatgtcaagatttctgattccaaggggaaaaatcagataacatgagtttcctgttgtgatacagaatgggaaacgctacattaccaatgatgtacaccagccagaagtgcctgggggaatctaatcaagcctttagatttcacttccagttcagtgaaatcaagggatataggaacaaggtaaacaccacaatcaggtgaatcctatattctacaggctggctggcctggtcttttccacaggtcattgtgttggagttgctcatctttatatgacaaaccaatgcaatgcatggtcctggttgagacaaactggctataagaggtcttttgggaacaactgggcaaatttgactaaggaatcaggttaattttggcaatgcaggaaaatgttcttaatttctggaaataatgcaattttttaaaatgcatactaaatgttgattactatttataatttatgctaaatattttagaatataaaaaggaggcgtttttaaaaggcaagatttccacaggttttgattttgtagggggaaattaaggagaaggtaattgtctgccaaaaaaaaacagtgcaattaagaaaaactggcttgaactagctctttccagttctacagcagatgtttgctgtactggagttatcaagaagagcagatggccctctgataaaccctgctgtgcatagactcagcaatgcagaccagcaaatagctggcatggaaaccaactgaaagggatcgaagagatttgttgaaactaggggcgagggtcagctggaaaaacaattcctgctttgcaatgatcacagccatgatttgatactttatgcaaaatcataaacaaagttaagcaactcactttggctgtacagtcagctgccttgaaggtgagcacatattttatttaatcagtaatgaaaatcctgaaaagagttgcagaagggtgcaattttgcctcatatcagtgttgttttgtgaaaggattttgagaaaagtagatggggcatgctagtggtgctattgctggcagtcacgtttcatttataacctccattatttatctggagcacagaggtgggaagaggagagaaagagaaataaaagttgtattttccatgatacaggtgcagatgagcccgcctttcaaaatagtgaagttggaggagaatcttttcatctggtggtggcaactcacctcgagggttctgtgctttcataactaatcatgttcaaccattttttaatttattcactcattcaatcactcattcattcactgttcaaataacatttatttagtgcttgactatgatagtcactcttatatgttccatagtaccctatatttatcattaataagttcaatgtagtttttgcttatttgttttggtttttttgtttgtttttgagacagagtctcactttgttgctcagactggagtgcagtggcaagatctcagctcactgcagcctccgcctcctgggttcaagtgattctcctgcctcagcctactgagtagctgggactacaggcgcccaccaccacatctggctaatttttgtatttttcatagagatgggtttcaccatgttggccaggctggtcttgaactcctgagctcaagcgatccacctaccttggactcccaaagtgttgggattacaggcatgacccaccatgcccggccagttcaatgtagttttaatactcccttggtcattcctgtttacttgcctattccctactcaacaggacagtgaaaacatcttgttagttgttgtattctcagcatccggcacattatagaactcaaaaaaaaattgttgaatgaatgaataagtaaatgaatgtacaaaccatgctaaggtcaaaggatgcaaagatgaataagccactctcttatgttgccttgctgaatcctcttgtcaaaagtattttgaagaacacgcacatggtgtaggacagaccagcatcagattgtgctcttttaaagaagctgaagttgaagagactggaaggaggaaatggggggcatcagaaagtgaaatggcaggctgtgcaaacagaatggctcagggggcaaccctgagaaggcccagaccagagtagatgaggaagcatttaggacagaggagagagttaggactcagggtcattagcaatagacaaaagtgcacattcaaaaatgcatcattggctgggcatggtggcttatgcctgtaatcctagcactttgggaggctgaagcatgtggatcacttgagctcaggagtttgagaccagcttgggcaacatggcaaaacctcatctccaccaaaaataggaaaaattagtggagtgtggtggcgtgtgcctgtggtcccaggtactcaggaggcttaggtgggaagatcgcttgagcccgagaggtggaggttgcagtgagccaagattgtaccactgtactccagcctggataacagagtgagactctgtctcaaaaaaaaaaaaaaaaaaaaaaattaaaatatgggaaccattttaatgtcttaaaa

SEQ ID NO: 195 - DNA, 18115 bp, Homo sapiens
tccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaacttttattgctttgcaaggaagctttagtattaaatgtaagcattttcatctggtgattcttcccagtctcctgtggtaataatacctggacagggaagaaatcttttgagataactaaactatactgggaaatgggccccttgctaagtttcctgtggcagtgacaccccctctgttgcaaatattttctccgatgcgtggtttcagttccaagccaaacccgttctacagcgtgctttgtacctttccagagactgatcggtatcagcttgccagggctttaaaccccattcattctttcattacttaaaagcctctttctttggaaaacctttgagtgaagcataaaattagcatctaaaaagacatagcagcaactgaacccaggaacgtcagggaatatgtgaccaccagcaccattattgaccttcctaagtgcagtttgatgggggaaggggctatgcaggtggaaaaaggtggccgagaggtggaggtcccccggcaggggcagtcgcctctctggcctgagccagaaactcccaattctcatgggtggctgatgagagaacccctcccctcctttgtatttaatcctttctctaactcacttctaagctgacatcagaaaatctttgaagaaaagcacaggggaggcctatttcagtgactttcacttctctaaatgtttgttcttttcagttagttgtaaaatatgtttgaataatattttcaattctctttcaccactgttctacaaaatgtgagcctgtaggcattgttttttttaaatgaaaaagaaaagattgattttaggaatcacattcaaagtgtttgatgaatcagggctcagcttagcattcaagaacatggctgggaagtttccactttgttttcgccctagattcgtctttaaatcttttgtctcctatatttttccagctctgtggacttctttgaagagaagagggctatgaggattgaagaaagaaaggcttttatccagtaatttgtaatgatcccattggatgattatggaatattttttgtatacgtaacccctcagggaaaatctgagcctatctctacccttaaaaactctggtagcctgatggcgggtggcggggagagaagaaatcctgtttctcctttccctgattttgtccccaaactacatcttgctttgaaagtagaggagttggaaggagaggagttagtctctcatggggcccctggaaggcagatagctgccaatctttgtgtgcattttgtcaagaatggctgccttctaaaaacaaaccaactctcctcgatgcctcaggtcagggatctgggagagactggattgtataaaagatgtttccaaggcaaaaaagcattgctctcttggggcatttacagaggatgtcatcagtgggcacttggaagttctagaagtcatgtggggtgctggtgtctgcagttcctggtgtgctcaggacattctgtgtctgcatagagggttgctgccctatggctggccagctcatacctgcacaattacttccagcaccttggcaggcaggaaagggactacaaatataccaacagggtaggcgtttgctctggggaagaggctgatttggggtgaatagttcataccacaggaagcccgctgtgtgtggtgggcaggtgacatttggactgggctcctggtggcttttggctctcttccagtttggcctaacaatgaaattacacgttgaaggggtttgttactgttgatctttattccacagcctggcttcttggtaaaggcatccatgttgtccgtgtctacatttcctcatctcccattaattccccaccagcccacagtttgctttcagccttcacagctcctgggaaatgtctccccatctgttgccatcctggggcccctcccgaggcttagtctccttcctcttctgcccagagctcagccccttggctgctttgccacctccctcctctaaagtcacccactttgggagcttctcatttttctgtctcctttgccctttccttatgtttagttgttcccagactcctgggacttaagttcaaaccccaactctaccatttattaccactgaggcctgggcaggtcatataacttgcttcaaccttagattccttccctgtgaaatggggataatatagtacatacctcatgtgggggaagatgcaaagagacaatacttataaagtgatttacatggagcttcttatggggaaagtacttactagatgctagttaacatcactgttactcctttctcactctgcccactgtccacccactacagccagaggccttaacagcttccattctttgaaaggttgccctctagcctagcccttcctcctcagtctacaccccaggatgctgggtatctccagcaccataaatattgcagagcagtgagtaatacctgttgggttcactgaacccacttcataggccccactccctgtgctcagtgagcaataagtcctctcgtagattccacactgttaaatagaagaaataatgctgatcatggctgtgcactttgttcactatgcaaaggtacttgggagagcaccgctggctggagagtatatggtagctgggggacccaggaagaaggtctttctctatctcaagccttctttgaaattcagatatgttggaagacttcctagtgtctttcagggctgcgaagttacccaacaacctttaattgtgtgcattgctttttttttttttttttttttttttgagatggagtcttgctctgtcatccaggctggagtgcagtggcatgattttggctcactgcctccgtctcctggctggtctcaaaatcctgacctcaggtggtccacctgccttgacctcccaaagtgctgggattacaggtgtgggccaccacccccagcctgtgcattgctttctttctttttttttttttttttttaagacaaggtcttgctctgtcacccaggctggagtacaatggtgcaatcttggctcactgcaacctctgcctcccaggctcaagcgatcctcctacctcagtctcccaagtagctgggactacaggcacacaccaccacccccagctaatttttgtatttttgtagagacagaacttcaccatgttgcccaggctggtcttgaactcctgagttcaagcaatctgcctgcgttggcctcccaaagtgttgggattccaggtgtgagccaccacacccagattctaatatttttctataatgcgagatacaacctcccacccgtgattgtcgtgatataaatataaacatatttggtatggaacccaggcctgaaacctaggctcaccattattgtgtcaccttgtactgtgactgccacccctcgagctggcccctgccgcacaagtcacatgacctctgtgcagagggcagaatctgctggttcctcctgagtgtcaaactcctagtcccctgtctccttggggccagctcccttctttttgctgttgggactgaccgaccgcccatcacagcttccagcgctgctgctcagagcccctccccgtgctctaaggagctgcccctctcctggcattctcctctcttcccttcagtctccttgaagtgtggagaaagaggcaggcattttacagccatttacagccaggcacagtccttctagcccgttggagagaggcctgtctgtgaggaggggaggtctgtgacaaagattctctccttgaccaaactctagcccagcctcctctgagctgtttttcaatgaggctctctccttagacacatccttaaaatcccagttttagcaagaatcctgctaagtcagtttagcctcgatagtgggtcaccctccgtatctgatcaaatcctcgcccccaccatagccttggcctgccttcagcaagagccctcttagttgagtatagccagaatccccatggcctgatgtttcatctgaatcattttccatctgctgagcctcctgccctgctccatggctaacaactcccactttcccctatctctctgtcctgctgcaaaatcccattgcggtggtccctgtcactatcatgatagtcctgagtaaagtccgtcctttaacaagggtgagggccagttgtggtggctcacgcctgtaatcctagcactttgggaggcttaggcgggcggatcacctgatgtcaggagtttgaaaccagcctggccaacatggtgaaaccctgtctctactaaaaatacaaaaattagctgagtgtggtggtgcacgcctgtaatcccagctactaaggaggttgaggcaggagaattgcttgaacctgggaggtggaggttgcagtgagccgagattgcgccactgcactccagcctgggcgacagagggagactctacatcaaaaaaacaaacaaacaaacaaaaaaaccccaaaaaaccaaaaacaaaaacaacacaaaaacaagggtgagaataatcttttccttaacatgtgggtggaccactgctgcaggccatgtgagatgggaaagctgggggcccatatccagctttccctgctttcccattggggggctccatgtggatgtaacaacaggagaagctacaggcacgtcatgatttcccttgttctttgggaaatctgaaagaatgaatcctttcctaatcccagaaaggcagccaacctttgagaccttgagggtagactgcaaagttcacatctcacaggggtcaggtaggttatgtaaatttgtaaagtgttcccggtgctacgaaagggaggagtggagactgtggcaaagcagagaacacatgtcccatggaacgctgtcggtcggctccaaccagttacggcttctgggactgtgggcctggtcttgccagtgcacctgaagacaggaagctgggtttttacatgaaaattcgattttgtaaagtgttggcaagtagtaaaaatagagtatggtcaaaacaactcagaattttgccttcaggcatctggtttgtaatatctgggctagagtctcattatccctcttgttgagggagggaagttattaggaccgccagtgggaaggaaggaggctgctcactggcaggaagagggaagtggtgcaacctggagtcaaggtggatggcttaggtttaggcctttgggggatttccttggggcggggggtgggacggtgcactgtgtgcctgcagtgtcttcagtgggcacctgagttgcccctggagagctgccagccccacctgaaagcctggacttcttggctcagatcttcatgtgaggctcagccaggaagaaggggtgccacccacctttgtgaggccacatgagttatgccagcaaccccagatccataggaccttcctccagttggacttctgtggactgcacaggcccaggagttcctacatgagcccaaggggtgtggagagtgcaatccccaaaacatggctcagactggattatctgccaggtcggggactgagggccaagccatgtttaattgatttagaaaatgaagagatggaggccgggcatggtgtctcacacctgtagtcacagcactttgggaggctgaggtgggtggatcacgagtcaggagttcaagatcagcctggccaacatggtgaaaccccatctctactaaaatacaaaaattagccaggtgtggtggtgtgcgcctgtagtcccagctactcgagtggctgaggcgggagaattgcttgaacccacgagccagaggttgcagtgagctgagattgagccactgcactccagcctgggtgacagtcgcaagactccatctccaaaaaaaaaaaaaaaaaaaagagatgcaaaaatatcccaggtatcttcgtatgtcagtatatgtgtgtgtgtttagtatctcctgattgggacccagtttgaaagcctgagagttctggagatgtggatgcctgagaatcatggttttactaggcaaagattttctcctcttctcaaaatagctgtagctattagacatcctaagtatttaggttccatatcactttctccagttggggccggttttaggaaattgtccaggtgcctggtttccttgtacaaacaccttgctgacttacccactagtatcgaagccgctgagttttcatgactctgtcactgactttaatacttgcttttcccttgactgaacttcggatgtttaaatggaatttagtgacgttttcacaccacatttttcattatttagcactttggaaacagaggttgttttgttataagctttttattcttcttaacctcctctgaatacttgaaacctttcacgacggaaatgagtttactgtgacctgactcggtattatacaataaacgcatgattctcaaaacacgctgtttatatggagaataaacgcggtccggaacacagtgttcagtgtctgaaatgaaatgcaagtctcctgtttccaaaggctgacaggatggttgctgaatgatattccagctgctcaaatgaagggccctggaaaggtctgttggaagtgaattcgagggcgttgcctcttcgtggttgggtttgctctctgcagacccaggaaggccctactttccctgaattctgagcttcaaagcttacatctgtgtccttctgcttaacaacctgttttagcaaccaagtatgccaagatgttactgtcacattaaactgtgtacccctgcactctcctttcctttcctttcctttctcccctccctccctccctccttccttcctttttttttttttttccagtatctcactctgttgcccaggttggagtgtagtggcatgatctcagctcactgcaacctccacttcccgggtacaaataattctcatgtctcagcctcctgagtaactgggataacaggcatgtgctactatagcctggctaattttggtgttttagtagagatggggtttcaccatgttggccaggctggtctcgaactcctggcctcaagtgatctgcctgcctcggcctcccaaagtgctgggattacaggcatgagcgaccgcacccggcctgcgcttcctttcttgatcacaccaccacagtcttgacctgcaggtcaatctataccttatttgacatgaaatattgtcagcaagtctaatggaatattccaccagagtgggaaacccatctccaagatgcagtggtgagctattaattaaagctggctcgtgccctcagagcaactttctttgatgctgcttgtgacaggtcaacctttgcatcctatgcccagtggagcctgctctgcctggtgttatcatttgtcctttagggacggcgtggcctttttcttcatgtctgtgttagatgtcatccaagtgaattgcttctttctctttcctgtttatttgttatagggtgtcacctcttagccatctgagcactgggctggctgccaaaaacagaggtgatgatgtaacgtgccaactctcacatggctcagaggaggaggaccccaggactccaggatgggacagggcagccacttctcaccaaggtgacactggggcttctgagccagcctctgagtggggaatggggggaagggcaacatgatggaggggtcagtgacacacccccgtccccatgaagaaaggatttctactttgaaattcgtctactagaaactaattccttctgctcagttttcttcctcaggaaggggtgtgtgtgtgtgtgtgtgtgtgtgtgtgtgtgtgtgtgtgtattttgacagttctttctttttctttctttctttgagacggagtttcgctcttgttgcctaggctggagtgcaatggcacgatcttggctcactgcaacctccgcctcccaggttcaagcgattctcctgcctcggcctcccgagtagctgggattacaggcatgcggctaccacacccaactaattttgtatttttagtacagacagggtttctccatgttggtcaggctggtcttgaactcctgagctcaggtgatccacccgccttggcctcgaaagtgttgggattacaggcgtgagccaccgcacccggccaacagttctttcttcaaaagtgttacatattcattgtagaaaaatttaaaaactcacagaggcaataagtcattaagatcaatcaagaactatatacatataatcactattcaaacctgaggggtgtgtgtatctgtgtgcgtatgtttgtgcatttgcacacgtatgtgtagagacagaatttcatttctttttctttctttttttttttttgagatgaagtcttgctgtcgcccaggttggagtgcagtggcacgatctcggttcactgcaacctccctctgccttctgggttcaaccaattctgctgcctcagcctccggagtagctgggacgacaggcgcccaccaccacgccctgctgattttcatattttttgtagagatgcggtttcaccatattggccaggctggtctcgaactcctgacctcaggtgatctacccattttggcctcccaaagtgctgggattacaggcatgagccaccgcaccagtataaaaactggtatcatgtaatacacacattttcactactttaaaaaaatttgtcatgtggtgaagactttttctttccaataaatatcaatctatatcattattacatgggtctgtcaaaattggtttaaataaagaaataatttagtttccagatttatgcttgggtgaaggtgtttgaagttaatttgttttttcctctttttgagacagtctcgctctgtcatccaggctggagtgcactggtgctatcgtggctcactgcagccatgacctccttggttcaagtgatcctcccatctcagcctcctgagtagctggaattgcgggcatgtgccaccactcctggttaatttttttttttttttttttttgatattttttatagagacagggtttcaccatgttgccaggctggtcttgaattcttgggctcaagtgatcctcctgcctcagcctcccaaagtgctgggattacaggcgtgagacaacactcccggccccgggaaaaactttttacttcatgaagatgaaatattggacccaaatttctgtcttcagtgaggatttctttggagaatccttggccatatttagctttaattcaggcggtgctggactcacgactcagtgtgtgcattggagttctctctgcagtgctggctttctgaggaaagggtatgaccgcaaacattttttcaggatatcagaactgccttcctaccgaccctttggggctagcaagaagtgaagccatttggatgactattcagggcgctaaacagcctgtctgcttcatattgctaaaagaatccaacactcatcttttctcacctaggagctgcatacaatttcagcaactgcaagggatccagaccagctctaataatcaccacttctatatacctagtggttagaataggctcttttccaagtgctttatgcctattaatttatttactcctcatgaaagccctgagaggaaggtgctgtcactaaagcccacaccactgcgggaacacaggcatccagaggccaggcaactgtgaaactgcctttgcaaaattaagactaagacagtgagagagatctaacttaaccgactccatcttgcttctcacctccaagctgtccttgttcattcctgggcatagactgaactaactttgggaaatacttagtttatagtttatagtttaaaacaaagacgataacagccctttcccaaagctgacctccttcttgcctggggactagattgcctttgtaggactaacatcagccacaaggttagaaattatagtttaggagtcgtgcagctggaggctacaagattctgaccctccctaaactgctcctaagatcagtgcttgagatatttgcagaccctgcacttgatggatcagctggcaccaccccatcaataaactggctcacctgatcctgtggcccccacccaggaactgactcagcacgagacagctttgactccctgtgatttcacccctgaccaatcagcaccccggctcactggctttctcctgcccatcgaattgtccttagaaactctgctcccagcatgctcggggagactgatttgagtaataataaaactccagtctcctacacagtcggatttgcatgaattactctttgtctattgcagttcccctgtcttggtgaattggctcaatctaggcagcaggcaaggtgaaccccttgggtggtcacaactggcccataagtgcgaggctcatgagcagcgaagcaggccagccccccaggcagctggctctgaccactaacgctttcccatttcccgtagaactggtgtgcagccattagttcacacaagtcacatgaaagccctgtgtttccaaacgtgcagccgctccgcaccacaacaaatatcgtgttggtcggaaaacaatagctctcccctcagacacacagtgaaccttctcattctgaatatgtccatttcttcaataactacaagaggtatctgctatgtgccaggtgctgttctagaaacacattgatattctttttttttttttttttcttcagaagccagttggagtttatggtttcatttgcccaaaaatacgcctttggggacctcaaattctttccaagaatcactaccacacatattaatttgaacatttcccacccttccaccatccctgtttctcctgagagcttcaaaataaaaatggcctgtgtgcccccactccaggtcctcgtgcagggctctctcttcttctctggggactgcagttctgacgcagatgatggtgctgttccagtgctgggccattgcacaacacgagttttgtttccgggaatttttttttttttttgagagggagtcttgctctgtcgcccaggctggagtgcagtgatgcaatctcggcttactgcaacctccgcctcccaggttcaagcaattctcctgcctcagcctcccgcgtagctgggactacaggtgcaggctgccatgcctggctaactttttgtattttagtagagacagggtttcaccatgttgcccaggctgggcgcgaactcctgacctcaggtgatccgcccgccttggcctccaaagtgctacaggcatgagccaccgtgcccagcctccgggcggttttatagaaggctttagactgtgttcccagccctcggatttggacaccaagccacctcgcttctcacctcgc

SEQ ID NO: 196 - DNA, 38236 bp, Homo sapiens
tccttatttaaaatagtgctcacattattctgctgagaattaccctctgatttcaatgcagctatatttatattaaattcttttagtatattctctattatttttcttgactcagtgtaggaaggggttatttctgcatatgctgattctgtcttcttgacattctgcattatgttttataattgaatattttaaggaagatattttaaaatttggtcatgtcactaattttttttcatgttatactgatgtaatgctgaacccctattaacctcaacagggatggcaacatgttcaagagactgaagaagagacccagagccagcaaacaggacatagggctttattagcaggaaacctacaaagagggagggccagtggcggcaggctggacaggagaaccacacagcccagtgagggggtgctgggctggagaaccatacggcccagaggcagcaggctgggcaggagaactgtaaccacttgcaaaaagcatgtagtttatatagcattttcactaagcaccctccccctaaccatcttcacctggcaaccttcacttaacccaaaacaaagggcctcaatcccctgtatggcctgtgtttcactagacaggccaggggctcagatgttcctcatagataaggaatgaatgcctgggttggccactcctggattcctcagcttggaactctgaacacacattcaggtgcctctgccatacagggccattctcaggttatggctaagttaaggtactgctatcaggtgcttctaccatacagtccaccccagctaccctggaacagctctcacatttttatcacgctattcttccatgatttccctggggccaggtaatgtggagaagcatcgctgccagactgctgcagcagcaatgcaaactaaaacaaaaaataatccaacttgggagttaattttggattcaccacagcaggcttatgatggaggagaggggcagctcttcacaggcccaacagtctgttttgttctggagagaggccaccatctgtgcccagttggtaaagagggtctgctgcacaccatctgtgggtggaagatgagatgtttagtgggtacaaggaagggcaataacagccgttcaacaagacacaggaagttgtattgttctgagaaagcgtcatccttggcagtggcctgggacctggctgacatcaccaaatggattggccccctctgggatgcattgcgggaggccagaataagacaatgggagtatcatgatgtttcataatgagaggatgatcatcccctttcacaagggaggaccaggattcattattttagaaatatgatggggagcagggcgcaaaataggtgtgacctgtgtatcttggtctaggcccttcccccatggagtggaaaaaccaaagcatcggggactggcttgccatttccaagaccacataatgatgtgctccccagtggacaggtcctgtggcaaggacaatcacaggttatcttgagtctcaggatgggacaaaggagtatcgtcccttaccttgtccacctggatcctgagagtggtatcacgttcttgcatcggaaggacataggcactggtgatgagaacgccatgttcattcagggtgcagacaactgctggtaaatggtgtgtccacagagccagagtgcgtctcctgctggagttgttgcttcaacagtccattcatcctttaaatcagccccacggctgcagggatgtacagcaggtggaaatgtcagtggatatccagggcctccacccattcctacactttatgtctggtaaagtgcaagccctggtcactattgatattggtggggacaccataggccacacacagccactctagtccttttatgatagttttctgggtagcatgcttgctgggatatgactgtggtagccctgtgcaggtgtccacataagtcaaggtatagtagcagccattagatagaaacaaatgccctatgtagtctacctgccaccattgtactggactctggccccaggggatctctccagtattgtgtggcaagggcctagggcattcctgtgcatgggtaggacattgctgacagaggtgtactatgtctttatgtcatagtggcaggccctaattcttcactgtggcccaaagggaatgctgtccccaaagtcctgtctttttgggcagccagtgggccacgtctgtggggactaccttgaagagatgaatgcaggctagcttgttctcatgttgatttccagatggcgtagatgcagtgtgggcatccacatggaagactgttacatgcattccctggatgtgacagagaatgtccttccacatgccagcaccccaaagcaggcagcctgctactgtccaatcctgagcttctccttgtggtagccacatagcaagtcccttaaagatggcccagctgttggtacacaagactattgggtccggctcatagaggaggatcgtctaggtggctctcagcttagcccatttgttactaagtcctaggcctgtatcaagccagatcctgtcagtggacagctggatggctgcagctgtccatgtgcaaggattgcctcatagcaagctctctgtgtaccagatctggtcaagaattgggccctgtccctcctgtacaaaggaggaaatctgtggaggttcagcggcctctttcaaagactgtctttcagatgttacataggtgacagtactgagcaccaaatggagctctgtgctcaaggggctattaatgaatgtgctcctttgttgaggtatgcatgccttttggctacagtctgtgtttgggcattcccaggctttagcttccggaaggtaccctttagtcaacctgctattggtactgggtgcgtactagcactaggacccactttgtaatgtcctccacttattgtaaagcatacatagcccagagttgtggcactccagctagctgaagcccccttccacagctgggaccagaatcctaaaggcacacatttatgcccttgccttcaccacaggccccacccaaacccctcagggtaactggctacgttcagttcacaaggctgcccctgcactacaagtcctaggcttgtatttgtttcactgcaactttagcttgttcaaaggcctcatcctcctttgtggaccagtcccagtgggcccccatcttgactagcagtatagggacctaaggagttgggccaaatgaggaataaaaggataccaacactgtaggaggcctaaggaagtttgcaagtgctttggtgtggtaggacatgggtaggcctacaccttatccataagagcagactgaaagaccttcgtcttacccaaccagatgacaaccagactgacaaacctggcctctggtctttgtatgcgttgactgccaatcctttgttcgccaagtgagagggtaaggtgggggctgtgcagattataagccagaaaaagacctaaaagttaatggaaaacatgtatcccctccagggtggtatccctgggcaagacagtccattgtttttcttcccatgtgaatgcaaattggtcttgactctctgagggcgatgggggatgccgaaggcattggctatcaatagccaaatggtatatgcccatggcttctcctacccttgtcccaagagaggtgatattgagaacagccacatacactggggggaccaccttacttaattcctagtaatctactgttattctttgtgtcccatcaggcttctgcatgggccattcagggctgttgtatgggctgtgcactggccttatagtgcctgcccaggctaactcccatatagtctctgtgatttcatcatgtccccacccttgcaggtggtattgctcagcacctctactcacggcagggctggaaagtgtcctggtgtccattttgcattctctgatcacagggttcaccacctaactctccgtcagaattcccctgcagttgtttgtggggtcaggcctgataagttatctactcccaagatgtattctgggatgggagcaaactataattagtctacaaaatgttgaccatttaaataaaaaattttctaatgtattagttgtaaaagtgcctcctatcacttcatatttttaattaatacacttagttttaatgtcttttatctgttctccatgtactctcaaaagtatctttttcaatgcgttccactggtttattttctctctgcctcactctttatctgttcattatttgtttatttatttatttatttattttgaggcggaatctcgttctgttgcctaggctggagtacagtggcacgatctcagctcactgcaccctctgcctcccgggtttaagtgattctcatgcctcagcctcccgagtagctgggactacaggggtgcaccaccatgctcagctaatttttgtatttttagtagagacggagtttctccatgttggccaagatggtcttgaactcctaacctcgtgatccatctgcctcagcctctcaaagtgctgggattacaggcatgagcctccgtgcccagcctgttcattatttattatatgaagtgtatagggtagtgattaagaccagcaaaagttctggagctattgactgcctgagtttgaatccatctgtgccacttactagctctgtttcccacgtgtacaatagaaatagtaataatatttaattcatagggttgttgtgagaattaaatgagttaatatatgtcaggtatttagaacagtaaataccttacagtaaggttctcaattatcttagcctgacagtaagttcccagttgttagccattttcatttttatataggctaattgagccaggcttctttcagttttcctcttctttcatttttcagactggcaccttagtacccagagttcagcagggaggccaggaaccttgttaggaagtagggagaggggagaagtctacaaatactcataatgtaatatccattcttttatctttgtcacatctaattataaaaacaaagacaaaagaataacttctgacttttacatgtaaacagatttagccctatattgcttccccctttcctcctgcttatccaactctcacatatatcctaagattttaatagtttttcttcaactgtgtaataatttttaagtgtgtttatttgattttagtgtttaccacatttcctttaatactgtaacccaaattatatctgaagtagtggcccatgagctgtaagggaaatgtttaaatagacagattttgagatttcaaacaaaatctccagacctgaattctttgatatcctcattcccaggagattgtgataaatgccaggtttgagaaccactgttttaaccaattgagaaatgaaacaaagtgaaaactcaagactggtgagggtagttggggagagtggtgatgtggttgaccattctttctctattagcttggaagatctatattctagctctcattctacatctctgactactttttcttcattttgtttgttccagtttttaaaaaacagatcccactttctcttaaataggttccccgccccccaacccggagtctattttggtcctctcttcctttgtttgctctcttagatcttaatattaactctcacttttctgcaagcctgttccccaagcctgttatacctcaagctctcaggaaaccgaggtcacattttcaacttgtctaaattctgtatctctgaaaacaaacccttcccctctcatctttctctttcattcattatgtattctctactcatcacctgggctccaccctcttctctttctactgcctctatcaaaattcatgctcatttctgttggaatgcactatagtgtcccctccaccttctgcctctttagtgcatcccggtatcagattaaccttcctaaaatattattccattatagtgtaatgattacacaatataaaaaaaaacttttaggttcgggggtacatgtgaggatatgttacataggtaaattcatgtcatgggagtttgttgtacagattatttcatcacccaggaattaagcccaatacccaatagtcatcttgctcctctccctcctcccaccctgcaccttcaggtacacccatgtctgtcatttctgtctttgcgttggtaagttctcttcatttagctcccaattgtgagaacaagccgtattctgtaacacaggttttctgttcctgcgttgtttgctaaggataatagcctgcagctccatccatattcccacaagacatgatctcattcttttttatggctgcatctgtcacacaattcttaagctcaaaatctttcaatgattgttcagtttatatagagttcagattattcagcttgatagccgagaacttccaaaaatatctcatgtactattattatatctcttattcctaatatttctctttactgccctaaactctatcaactggaaatgctccctaattaagggccctcatttcccctctctgtgttctcatccatttctctgcctagaatatgttttctgctttacttgtcctataaccttagcttttccttcaaagctcatttcaaatgccacttgctctaggaagttgtccctgagtaccataggtgcaaatggtgtcttcctttgaattctcatagattttatctgtcaagtgagtaaagacacttcacatttttttcatttattttcctgccgttattttaattttaaaatgtactgactacattaattcacacaattcaaacaagtaaaactatgcagagtgaagagtgggagttcttcagtgctttgccaaagccattcccatacctacaggaacacagcattactgtttagtatactatatccttctaagtcagtagttctcaaaatgttcctggtaaactccttgcttcaaaccacctggggagctagttaaaaatggaggtgcctgtgcatcaacccagcccttccgaattggaatctcttggaagtaggaactaggaagctgcactttggtcattcttaatcatactaaattttgagaatcatcccttttatctatgcattaaataagagttcttttacaaatgtataattttgtttttttgtttggttgttatgttccttcagtaatgctattggctttcttttcatttttagcaatgcatctcagagatattcataaaacaaatgtagagacgcactgtgtgtgtgtgctttttaaaaaatttttaaactctatagaatacatttaccaagattgatatagctatttttctgttgatggacatttaggctttccagtttttaattattaagaacagtgcttcagtgaatgtgtaaaatttgcacacatggtgataagtttatggagtagaagttgctgggttaagtgcatattcaaaatgcttatgctgctaaattgttctccaaacaggctttttgggttcataccaaatttccaccaattgtgaaagagaatattcatatccccacaactgtaatcagtagtacatcttatttttcagtttttcaggctggtggatgaaaaatagtatttccttgttgttttaatttgctcattttttcatgactggtgaggttgagctcctgattttcttttttgccatttgtatttccttttacatgaactgtcagttctcatttttgttcatggttattatttattgaattgtctaccatcagtgctattgaactgtccattatttgtctactgatttgaaatgtcatgtttgtcatactaacttcctataagtacattgaacagtttctgaactttttattctcttcttttaatgtatttgcatttatctcctatcatttatattatggtagctttgtagtttgcttttccttctttcttttttttttttttttttttttttttgagacagtgtatcactctgttgccctggctagagtacagtggtgcgatcttggctcactgcagcctccgcctcccgggttcaagcgattcccctgcttcagcctcctgagcagctgggactacaggcatgcgccaccatgccgagctaatttttgtatttatagtagagatggggtttcaccatattggccaggctggtctcgaactcctgacctcgtgatccgcccacctcagcctcccaaagtgctgggattacaggcgtgagccactgcacccggctttttctttcttttttaattttagagacagagtctcactctgttccccacgctggagtgcagcagcatgattatggctcacggcatccctgatctcacaggctccagaccacaggttcatgccatcatgcccagctaattatttatttttggtagatatggcatctttctatgtcgcccaggctggtctcaaactgggactcgaggggccctcccaccttggccttccaatgtgctgggattacaggtatgaaccactgtacctggcccatagtctgcttttatatcatcacctttattctttttcaaaaaatttcttggttatccctgtccattttttctttcatatgaaattttaattagcttataaaatccatacaaaattgtatttgaattttgattgagactgcaatgagttctaggttaatttggggaagatttgacaattttccaaatcttgatatctccccaaagcacagacatatttttgatgtttagtcttctcatcaggaagctggcagtctctgcagtcttctgttctttagtaaagttttagtattttctttaaataggtctcaaaactttttaaatattttgcttattgataagtatttttataattgttttgtttttgcaaacttgaataggattttttccattatatttgctaattggtttttgctgatttttaggaaaactgttgaagtttcttgcagttctagtagtttttcagccatttcatttacacttttcagtcaatgatgccatctatagataatgagtcttgtctcttcctttccagttattgtaccccatttatttatcttatcttactgaattagctaagtctgttggctcaacattgaacagtcatggtgagattgggcaccatgattcttctgtctttaatgaaaggctactagtgtttgttaatcaaatatgaggttttctataggtttgtggtagatgtcttttgtgatgttaaggaagatttcttctattaatctgagttaaagcttattatatggaagtgttaaataaatgctttttccagaatccagatgatcatttgagttttctctttaacttatatgttaatttggtggatatagcgacttacattattacttacctgaattcactcttggaaggaaaagaatcctcttgggtagtaatgaattgtgtcatattacttttatgtgatttcttagtattttatttagttgtatgacattaagttgtaagtgaaattagcctgtgaataggcagactaatggcctcacaaagatgtcctaattcgtgaaacctgtgaataagctactttacatagcaaaagggatgttgcacatatgagttaggttaacaaatttgtgctaaagagattattctagattatctacattggcccaatcaaattgcacaagtccttaaaaagggaaaacctttccagctgcaactagagaaagagatgtagcaacagaggagagttcacagagatgtgatgtgagaaggacttgtgctgactttactggatttgaagacagaggaagtgtactatgagccaagaaatggaggcagcctctattagaaaagacaaggaagtagattctcccctagagcatctagaaaagaatgcagctttgttgatgccttgattttagctcatggagacccactttggacttctgacctacagaactgtaagataatagatttgtgttgtgttaagccgggaaagtttgttagagtggcaatagaaaattaacatagcctatggtttcatctgtgtgctctccaagtttagaaacaaaactgtagctgaaaagttttctttttcaatgctttaaaacagacttcaaaaaaatcatttaagtttgataaaattaagctgttaaacctggctcttgtgcctttttaaaggagaaaatatttgattcttcaatttcttttgtgacatcttttcctaaacatgtgttataattctcaagtatatattttgtcttccccactagactggaagcttcttgaaggcataatgtgtctgattaatcttgctatctaacttagtacctaaaataatcccttacagtaatgcaaacatttatatagatatcttattcaactttgcatcctcatagcactatatacagtgtctaatgtttatgaaactaatttcaaaaatgtatggtaatttagacagcttaattgattaggtaattcagataatatgctgagtgaacatgagctttgaagtcaggcctgagttaaatcctggatgaaccactttcctaactctgtaaatttagacagttgattaacatctcaaagattcactttcctcactagtaaaatggtaagtaaaatcctcacttattttatagtgaggaaatgtttgtagagtgcttagcacaatactggataggcaatcgtcgctttatgttagtaagttatgaagataaaaaatgttatttagaatcaaatggtattttataaaaatgttactttttctgttgctcctgttgtaattttttaggctgttgtcatgtcaaaaggggatactaagtttccaatctgttcttgagtatacagtaatgcggtcaataactttagttggtgcctccaacaagtattatccgtggatgaggttacatctgggtactttggaatatgatagaagcaacatctggtgtgcttttatacagctcatgaagtcagtgctttagaaactgaattaaaatgtttcaagggttttcttcctatttaatgctgtgatgttgctaatcccgtcctcctcttaaagctggtgatcctcctcacattaacggccattgatatagtttggataattgtcctcactcaaatctcatgttgaaatgtaatcctcagtgttagaggtggggccttgtgggaggtgtttgggttatgggagtggattcctcatggcttggtgccttcctctgggtagcgagttcattttcacgagatctggttgttcaaagtgcatggcacctcccctactctcccttgctcctgccttcagcatgtgaagtgcctgctcctgctttgccttctgccacaagtaaaagcttcctgaggcctctccagaagcagatgccagcactatgcttcctgtacagcctgcagaagcatgagccaattaaacctcttttcttataaattacccagtcttgagtatagcaatgcaagagtggcctaacacagccatccttgatatttatggaaccctctcaggcttaatagttgactcaagcacaatgaataagtggtcccctgtctttgtgaattcatagataaaaagacaagacaatcttgtgttgtgacttgttttgtagtttccattgaaatcttgtagggtaggttgtagtgaagtgtgtatcttacatcattttctgggaattcatagggaagaaaaattgaagataagaaaatttaacactgattttcttgctcaatatggttctaaggagttgatatcagattttgaattgggtggtgatggtggagatgaaacagtgaatgtgtgcagaccaggcaagactgaatgaagagaaggaatggggctataaaagacactttgccaaaataaataatagtcactatatgtcatatccctactatgtgacaagattgttatctgctttatagacatcattttcaaacctatcgataaccttgcaaagtgaattttttggataaacaggccctgaggagaactttgccccagtaagttttcatagggttggtgatgcaaatctttctggatacaaaagccagtggaaagtagtacaaatcacgtatcccttatacgaataaagaaactgctggagtaccacttctctcctggggttgaagagatcatttaggtaaatactccttttaaagatgtaaaagctaatgatggtttacaaacttaaattcttacactagcaaggagtgggagctggccattggagagagagtactgacggacgtggtaagaaagtaggatttcaggtttagatataattcattttaatgaatgtgtgggaatacacagaagagaaattatatggctccaggttacttagtattgatctaagcttcagtttatacaaaccaatttagactttcctgaagtataaattgagttatatcttaattatgagaacatattaataaactaattaatataaacaggactagactaccccaaaagattcataaactaagcagcagcagtggccctgtatcatcacagttgcattttggaaggtaaaattaaccatttggaaatatgtattccatcaccttctttatgcaaggtacttatttaggctgaagacacaggacagaaaagggctttgcccatatatacagatgaacatggacaaagataaacttcagataattagagctatgcagagactttatggtattgtgaagagacaattttcgattatgtgtaataggaaggtgtcccagaggatgtggcatttaagcagagatttgaataacaaaaacaaactagccatggaaataaaatgtaggaggaagaaattctaggcagagggagtagctagtgcaaaggtggtcacatgatgtgtgtgggtgtgtgtgtttccccctaggactctaacacagaaggtgaaggagagaatggtgggaagttgcattggagaggtacggaggggctgcatcatttacatttggcccctttatgataaggggtatccatattaaagtaaattgcctctagatgggttaagaacagtgtgtcataaaagtcaagtgaacaggtttcatttatatgtaccaccagatgctgcagtgcaagaatgttttctgtaatgtttgtttttattttttgccttgtattaatgctagtgtatttaagtttccactgtcagcccctgaagagcagagcagacatctgctccttctagtacctaatccagtgccatagcacagaaattctcaactagtgaatcaatattgattggtgtagactagttaactatgttattgccacaaatgacatctaacctgagctagttatcccacaaatagtcctcacagttatgaaaagggaaccacagtgtgtgatgttccccttcctgtgtccatgtgtccatgtgttctcattgttcaattcccacctatgagtgagaatatgtggtgtttggttttttgtcctttcaatagtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgtcttccacaatggttgaactagtttacagtcccaccaacggtgtaaaattgttcctatttctccacatcctctccagcacctgttgtttcctgactttttaatgatcaccattctaactggtatgagatggtatctcattgtggttttgatttgcatttctctgatggccagtgatgatgagcattttctcatgtgtcttttggctgcataaatgtcttcttttgagaagtgtctgttcatatccttcgcccactttttgatggggttgtttttttcttgtaaatttgtttgagttctttgtagattctggatattatccctttgtcagatgagtatattgcaaaaattttctcccattctgtaggtagtctgttcactctgatggtagtttcttttgctgtgcagaagctctttagtttaattagatcccatttgtcaattttggcttttgttgccattgcttttggtattttagacatgaagtccttgcctatgtcctaaatggtattgcctaggttttcttctagagtttttatggttttaggtctaacatttaaatctttaatccatcttgaattaatttttgtataaggtgtaaggaagggatccagtttcagctttccacatatggctagccagttttcccagcaccatttattaaatagggaatcctttccccatttcttgtctttgtcaggtttgtcaaagatcagatagttgtagatatgtggcattatttctgagggctctgttctgttccattagtctatatctctgtttttgtaccagtaccatgctgttttggttactgtagccttgtagtatagtttgaagtcaggtagcatgatgcctccagccttgttcttttggcttaggattgacttggcaatgtgggctcttttttggttccatatgaactttaaagtagctttttccaattctgtgaagaaagtcattggtagcttgacggggatggcatcaaatctataaattaccttgggcagtatggccattttcacaatattgattcttcctacccatgagcatggaatgttcttccatttgtttgtatcttttatttcattgagcagtggtttgtagctctccttgaagaggtccttcacatcccttgtaagttggattcctaggtattttattctctttgaagcaattgtgaatgggagttcactcatgatttggctgtttgtctgttattggtgtataagaatgcttgtgattttgcacattgattttgtatcctgagactttgctgaagttgtttatcagcttaaggagattttgggctgagacaatggggttttctagatatacaatcatgtcatctgcaaacagggacaatttgacttcctcttttcctaagtgaataccctttctttctcctgcctgattgccccggtcagaacttccaacactatgttgaataggagtggtgagagagggtatccgtgtcttgtgccagttttcaaagggaatgcttccagtttttgcccattcagtatgatattggctgtgggtttgtcataaatagctcttattattttgagatacatcccatcagaagggatagcattagtagatatacctaatgttaaatgacgagttaatgcatgcagcacaccaacatggcacatgtatatatatgtaacaaacctgcacgttgtgcacatgtaccctaaaacttaaggtataataataataataataaaaagaaaataataaataaaaagggaaccacaaggcctactagatcagtgaaaattcatttactcaagacaactccaagtacataatgtcttaggtaatactctatataaagtggtttgtcacaagagctgtgcttgctttcttttgaattttatgcttcacattctgtgggaaaatgtattacacagtatctcacagaagtattactattaacctatatttacttataatactatcttctatagcgtgatgttaaaatttgataaattttagggaggaaaatgtttgtctttctttttttctcagacaagctcttagtctgttgcccaggctggagtccgttggtctaatcttggctcactgcaacctccgcctcccaggctcagatgatctttgtgcctcagcctcccgagtagcgaggactacaagtgcatgccactgcgcctggctgatttttaaaatttttgtgtacagatgatgtctcactatattgccaggctggtcttgagctcctgggctcaagcgatccgcctaccttggcatctcaaagtgctgggattacaggtgtgagctaccacacccagcctgttcattttattataaataatttgttggaactttctcagttatagaattgatgttagcagttcatttaaccgtaagactaaagggatggtttgtgacatcctgactcccattctgtatctcttcattccaactggcaccattccctaggcccacagggtcttccccactgccctcccctccccccacctgccctcaccttttctggtcacaagctccagaccattccactttcctatcaaaatatgtcttcttacttccaaattcccaagtccctgttctacttccaacacactgtactccagtactttaatccgtggtaatgattcagtggagccagagaatataaagctcattatacagttagttaagctgttaggccctctttctgtcttaagcatctttcttcttgcagacagtctcaaagatttttccttcttccagtaatcacccatttatttccaaggaatgtttcatccatgcctagctttaggaaacatgttattgcttggatttctattgaaaatatgtgtggcaatttggaaaccattttttcctgacttcattattctttcatgttttagcctgtcaatgcaaactctattatccagagatgcattatagaacaggagtttaagggagaaggaaattaatattggccatggtcatgttcgtattctttttccttgtagaagacaacaggcatagctagagtggcattagctaactgtaaaaaggatttgtagggctagggatgaatgtaaatgtaaacaacttaaatgtggattctattatagcttcacatagagtatctgtgaccacaaatcatattcttctcagtagctgatttcccacaccagttcaaagggctacagaagaaatactgtcatcaggacactacgaatagtttacttggatatatgcaataaaaggatgcaagtatattttctcgcattttcttcctaaagagttgcaaacagggctggatctagaaaatactgtttcctttttttggggtaatgctccctgccatttttatggtttacatgggcattccaatccatcaatagatttgttttacagctttcaaattattaatgacaaattcaagaaacaattctgcagtcaatgcctatggtctaattttttgtagttttcctttaacttaaaaaccatagaaagaagtaccatctttgatactactgatgggcccaaacttaaaaatttatgatgcaaaatagttttagctatcatttatgattactaaaaacaaccattgacaataaatattttatactatcacaaaaagcagactagctttctcataacttagcaaaggtgttatggttgaaaataaaattcaaaataagttgaactgcttaactcataattactaaaagttcatactctatagtgccatatgtaacaagattctcatttaaaaaaatagatgcatactaatttagaaactactgagatggttattttccttttttgagacctagctgtcacccaggctggagtgcagtggtgtgatctcagctcactgcaacctccgccttccaggttcgtgcgattcttgtgcctcagcttcctgagtagctgggattacagtcacatgctgccatgcctggctacgttttgtatttttagtagacatggagtttcatcatgttggctaagctgatctcgaactcttgacctcaagcaatccacccacctcggcctcccaaactgttgggattacaggcatgagccacccagaaaactactgagattctgaaacaaatttagaaaaaagcatacaaaccaaagtttaaggtacatttaaaaggctttccaattgttgagatttccatttctctgccaagagaaaaacagggtttagaaaaaccagcgtatctccttttacgcatttagagatctttaaattgttagctattgtagcctgcttgttcactgggttttgtagtgtgtatatatataggccaccactaatatacttcgggagctttgcattcacagtagctcatggatatgactttaacatgaattatcatactatcatggttatggcaattcagttttttttaagaataaagttattataatacaaacattccttgtagtaaatgtttgtattatgggttttttttttttttttgtaacaaagaatttgttttctacctttgttatcatttaacaagcaatttacaaaaccaagaaggaaccaaatctttgatttacatttctgctgacctagtgtgtggactcttgcagaggaatagcattgctgcatagtgctcagaaagtgtgggaaaacggaacaaaaagcttgaatccatttttttttctgcttttacatcagaatttatatttaggttatactttcctagaggaatgaacaatacatctctcttatccacaatgtgtaatttgctagttttgtgtttaaagcttttcttatttcctgttctacttctgtgaattaaggattttaagcaggggcaaaactgtagcatcagcaggtaatcattcttggatacagatactaagtacatgtagcatgcttgtcttcactcttaggtcataagctccatgagagcaggggacaatgatcactccaatccttgctgctttcccagcatatagcacatggcagaattcaaacatttgtttaataaacaacaacaacaaaaaacctttcatatcatgaggaagacatctgctgtcctgaaagagctgataaattatgtagcttacttaaaaaaaaaaaaagaatatgatatggttgacatacaataaagtagaatttatgctgttgccctgcttctgccataaacatgacaaaacatgacaatgggaagtcacctgagttctctggatctcagtgaataaatttatgacattaagggatttaacaaaaatgaaacccagtgggaaaattgtacaagtcactcaagttctaaattgcttcccaatgctgaaatcacttagtgagatacatcaaagaccacagaactttcggtttacaagtaacagacaaagaatactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgta

SEQ ID NO: 197 - DNA, 44264 bp, Homo sapiens
ttgtttcagtaagtagggaaagagttacatcattcagtctacaccttagaatcatctggcccagaccagttagagtttctgaaattagccttgggtgtgtgtgtgtgtgtgtgtgtgtgtgtgtgtgtgtgtgtgttttaaagcctccctcttttccagtgattctaatgtaaagcacagcttgaaaactactaagttattacctccattagtgcagtggttcttcaggtatggtccccagacaagctgcattaacatcacctgggacctagttagaaatggaaattataaggccctatccccagacctactgaatcaggaactctaagggtagagccgagattttgggattcggttcagatgtgtgtatcagaagactcaacagtgtcttaattgcagtttatttctctgtcttgtaaaaacggtctagaagtaggtgttccagagcagacatcgtcctccttggtgttagagatcctgattccttctttttttctaccctaccattctcaggatgtggcttcctcttcataggccaagatggctgcctgatttccagctatgacttctgaattccagtcagcaagtaggaaatgcacttccccccacccttactttgacacttcttggaagccgtatgacacatcagcttatatcacattgactagtatttagtatttatagagtctgcaaaaggtggtaatttcgggggcggccatgtgcccacctaaaatcagggttctctttcagagaaaggagaataaatattggatgacagcaagcagtatttgccagagttaactaattgctttttttctacctccaaaattctaaagtgagataataagcatcataactgtttgaacacttttggtttgctgttctaagtgatgctccttatttcattagtcttttcactgtattaatgatggcaagtatttattcatatggctgaactatgattaattcttcccctaattttgaatatttggaatgttacaatttttgctgttgaaagtgctgcactagggcttattgcatttgtgatgtactgcatttctgattatcacttcggaacgtagattcctagataggttaaagaatttgaacatcgttaaggctctttattcatatggctgattttcttgcaagaagggaaacgttttgtgctccattataagtgaactacatttttggcagcaaaaagttttgtcttcttaaactttttgttctttcaacattttgaaaatagtgcattactatcttcttgcaacctaatgatgctgctgagaaatctgatatcaatttgatttgcattcctttggaggtaatctgacctttctctcttagcttttagaaaattgtctttatcctaaatgttctgaaattctaccatattgaagtgtaagaagaccctatatttttatttagcagttcttttttattgaaggattgtaatcattcttaaattctgaaaaaaatattgaccatagatttttccagtattttctttcttccatcttctctgttctcttacttagaactcctatttgttgaaactgtatctaaacttcctttctcttttatattttggatctcttggccagctgtggtgactcacacctgtaatcccagcaccttgggaggccgaggcgggcacatcacctgaggtcaggagttcaagaccagcctggccaatgtggtgaaaccccgtgtctactaaaaatacaaaaattagctgggcgtggtggcaggtgcctgtaatcccagctcctcagaaggctgaggcaggagaattgcttgaacccggaaggcagaggttgcagtgagcggagattgtgccattgcactccagcctgggtgacaagcgtgagactctgtcacaaaaaaaagaaaacatttatatatatatataatttatgtatatcatatatataatttatatcatatataatatcatatattgatatatatgatataaaagaaaggaagtttaaatacagtttcaacaaataggagttctaagtaagagaatagagaagatggaagaaaaaatactggaaaaatctatggtcaatatttttttcagaatttaagaatgattacaatccttcaataaaaaagaactgctaaataaaaatatagggtcttcttacacttaatatataatattaatatcatattatgcttaatatacaatattatatataatataatctttaatataattaatatatatgttatataatatataatatatatcattatatataatacataatatatatcattatatataatatataatatatcattatatataatatattatatgttacatataatatataatatatcattatatatatcagttatatattatatataatatatcattatatataatatatcatatatcatgttatataatatgtataatatatcatatatcatgatatattatatatgatatattatatatcatatatcattatataatataatatatattatatataatgtatcattatataatataatatatcatatataatatatcatatataatatatcatatataatatatcattatatataatatatcatatataatatatcattatatataatatatcatatataatatatcattatatataatatatcatatataatatatcattatatataatatatcatatatcatatatcatgtaatataatatgtaatatatatcatgtaatataatatatatcatgtaatatataatatatatcatgtaatataatatattatatatcatgtaatataatatatatcatgtaatataatatatatcatgtaatataatatattatatatcatgtaatataatatattatatatcatgtaatataatatattatatatcatgtaatataatatataatatagtatatactgtaatataatatataatatattatatactatatactatataatatatactatatataatatatattatatactatataatatatagtatatactatatattatatactatatataatatatattatatactatatactatatataatatatattacatactatatactatatattatatattatatactatatataatatatactatacataatataatgatatacaatatataacatatgtattatacaattatatattttatatataaatatatattattaattattaatatattaaatatatattatatataatattatataaatatataatataattatataaatatataattatataaatatatataatataattatataaatatatataatataattatataaatttatataattatataaatatataatataattatataaatatataatataattatataaataaatataattatataaatatataatataattatataaatatataatataattatataaatatatataatataattatataaatatataattatattatatatataatataattatataaatatataattatattatatatataatataattatataaatatataattatataaatatataatataattatataaatatataattatataaatatacataatataattatataaatatataattatataaatatatataatataattatataaatatataattatataaagatatataagataattatataaatatataattatataaagatatataagataattatataaatatataattatataaagatatataagataattatataaatatataatataattatataaagatatataagataattatataaagatatataatataattatataaagatataatataattatataaagatatataatataattatataaatatataatataattatataaagatatataatataattatataaatatataatataattatataaatatataatataattatattgtatataatataattatataaagatatataatataattatataaatatataatataattatataaatatataatataattatgtaaatatatataatataatttataaatatataatataattatataaatatatataatataatttataaatatataatataattatataaatatataatataattatatataatctctttatatatatttatatattatatataatctctttatatatttattatatataattatatcatattatatatataattttatttctttggaagaattcctcaatgttgcagccaccaattttcttctcaagctgttgtcaaccaacaagaggctaaagaccagactacaatgcaataaatcagggaatttattggagtcctagaaattgcaatttaagagtcacagattcagctggaagccaaactgtgttgtgaagagaggtggagaatagggggttttaagaaaaaatcaaaaagaagctaagggtgattacataagttgtgttgaaagaattatcattggtgaagggggtggcttagtacaggagtccgtagttctttgattgttactgtcaacataagaatcttgagatcttaactttggagaggagactttcttgtaaagggttacagcctaccaggctggccattctgcagcctgggaagtacagcctctagcagagaccattagcaggcacttctaggaagggaaggatgagatagaaatttattctgaacaggttggctaaatatacatattcattagcttataagaggacttatgaatattcacaaagtggggatgtacacgtgtgtgataagcaagcatgcatgttacatgcattccatgttcactttgggacagagatttaacattgaaatgtattacagttaggccctatatgtcaaaaggtgaagtagggacacaaagacactcaagttcacagcctctgtaaatcagccatcaccagtccatagtctgtggtcttttatccatgaaagttactgatataggtctcttgtccaattaaagctgtaggtatggcttgtggaagaggggatgagttagcattggtggtggatgagctgcaattgttttaatattgcttatctcaaggccagcacttgttttgctgatagaggaaaagaagaagcaattagaacatagtttattcttaaaatgtaggcatacataacttaacccttgcctggcatgacattaggtctatttataatttggtatcttcttactacaaagagtccattctgtcagtcttatgagctctattttaacattagacaactgaccagcattaagctgcagaagggagggggtacaatgaggcatgtctgacctcccatcccttcatggcctggaactcagtttttaaggtttctctgaagtccccttggccaagaagggtctgtttggttggctggggggcttaggattttatttttagtttttattgctcaggaattaaattcagctgttttccaggctgctgtggacatggaagtttggctcagctcaaaggtacaagacaagtttctgggtttgtttggttttttcttccttcaagtctacgggatatgcaggcagtccttcttagaatggcttcccaattccatttgagagcttgaaccagagtgacaccattttgcgtatcacctttcacactatcattttaaaattttcccaggtcacttgtttcatttcttgaaatgtccattagcctgttatgatctcctgtttcttgtttggtggcatttaccatctttatcttttcaggatattaaatatacatgttttaagccctgttctgaatactcattttactgtttcatcagcttgtaaattattctgtttgttggatctgtcatctctctttcgtggtgttgactatctccagatgttaggagtatcttgcttttccatagtagcttttctgctgtgatctctgatgcttcttgctttaatgtcttgcagagactgagttttccttactttccttatttaaaatagtgctcacattattctgctgagaattaccctctgatttcaatgcagctatatttatattaaattcttttagtatattctctattatttttcttgactcagtgtaggaaggggttatttctgcatatgctgattctgtcttcttgacattctgcattatgttttataattgaatattttaaggaagatattttaaaatttggtcatgtcactaattttttttcatgttatactgatgtaatgctgaacccctattaacctcaacagggatggcaacatgttcaagagactgaagaagagacccagagccagcaaacaggacatagggctttattagcaggaaacctacaaagagggagggccagtggcggcaggctggacaggagaaccacacagcccagtgagggggtgctgggctggagaaccatacggcccagaggcagcaggctgggcaggagaactgtaaccacttgcaaaaagcatgtagtttatatagcattttcactaagcaccctccccctaaccatcttcacctggcaaccttcacttaacccaaaacaaagggcctcaatcccctgtatggcctgtgtttcactagacaggccaggggctcagatgttcctcatagataaggaatgaatgcctgggttggccactcctggattcctcagcttggaactctgaacacacattcaggtgcctctgccatacagggccattctcaggttatggctaagttaaggtactgctatcaggtgcttctaccatacagtccaccccagctaccctggaacagctctcacatttttatcacgctattcttccatgatttccctggggccaggtaatgtggagaagcatcgctgccagactgctgcagcagcaatgcaaactaaaacaaaaaataatccaacttgggagttaattttggattcaccacagcaggcttatgatggaggagaggggcagctcttcacaggcccaacagtctgttttgttctggagagaggccaccatctgtgcccagttggtaaagagggtctgctgcacaccatctgtgggtggaagatgagatgtttagtgggtacaaggaagggcaataacagccgttcaacaagacacaggaagttgtattgttctgagaaagcgtcatccttggcagtggcctgggacctggctgacatcaccaaatggattggccccctctgggatgcattgcgggaggccagaataagacaatgggagtatcatgatgtttcataatgagaggatgatcatcccctttcacaagggaggaccaggattcattattttagaaatatgatggggagcagggcgcaaaataggtgtgacctgtgtatcttggtctaggcccttcccccatggagtggaaaaaccaaagcatcggggactggcttgccatttccaagaccacataatgatgtgctccccagtggacaggtcctgtggcaaggacaatcacaggttatcttgagtctcaggatgggacaaaggagtatcgtcccttaccttgtccacctggatcctgagagtggtatcacgttcttgcatcggaaggacataggcactggtgatgagaacgccatgttcattcagggtgcagacaactgctggtaaatggtgtgtccacagagccagagtgcgtctcctgctggagttgttgcttcaacagtccattcatcctttaaatcagccccacggctgcagggatgtacagcaggtggaaatgtcagtggatatccagggcctccacccattcctacactttatgtctggtaaagtgcaagccctggtcactattgatattggtggggacaccataggccacacacagccactctagtccttttatgatagttttctgggtagcatgcttgctgggatatgactgtggtagccctgtgcaggtgtccacataagtcaaggtatagtagcagccattagatagaaacaaatgccctatgtagtctacctgccaccattgtactggactctggccccaggggatctctccagtattgtgtggcaagggcctagggcattcctgtgcatgggtaggacattgctgacagaggtgtactatgtctttatgtcatagtggcaggccctaattcttcactgtggcccaaagggaatgctgtccccaaagtcctgtctttttgggcagccagtgggccacgtctgtggggactaccttgaagagatgaatgcaggctagcttgttctcatgttgatttccagatggcgtagatgcagtgtgggcatccacatggaagactgttacatgcattccctggatgtgacagagaatgtccttccacatgccagcaccccaaagcaggcagcctgctactgtccaatcctgagcttctccttgtggtagccacatagcaagtcccttaaagatggcccagctgttggtacacaagactattgggtccggctcatagaggaggatcgtctaggtggctctcagcttagcccatttgttactaagtcctaggcctgtatcaagccagatcctgtcagtggacagctggatggctgcagctgtccatgtgcaaggattgcctcatagcaagctctctgtgtaccagatctggtcaagaattgggccctgtccctcctgtacaaaggaggaaatctgtggaggttcagcggcctctttcaaagactgtctttcagatgttacataggtgacagtactgagcaccaaatggagctctgtgctcaaggggctattaatgaatgtgctcctttgttgaggtatgcatgccttttggctacagtctgtgtttgggcattcccaggctttagcttccggaaggtaccctttagtcaacctgctattggtactgggtgcgtactagcactaggacccactttgtaatgtcctccacttattgtaaagcatacatagcccagagttgtggcactccagctagctgaagcccccttccacagctgggaccagaatcctaaaggcacacatttatgcccttgccttcaccacaggccccacccaaacccctcagggtaactggctacgttcagttcacaaggctgcccctgcactacaagtcctaggcttgtatttgtttcactgcaactttagcttgttcaaaggcctcatcctcctttgtggaccagtcccagtgggcccccatcttgactagcagtatagggacctaaggagttgggccaaatgaggaataaaaggataccaacactgtaggaggcctaaggaagtttgcaagtgctttggtgtggtaggacatgggtaggcctacaccttatccataagagcagactgaaagaccttcgtcttacccaaccagatgacaaccagactgacaaacctggcctctggtctttgtatgcgttgactgccaatcctttgttcgccaagtgagagggtaaggtgggggctgtgcagattataagccagaaaaagacctaaaagttaatggaaaacatgtatcccctccagggtggtatccctgggcaagacagtccattgtttttcttcccatgtgaatgcaaattggtcttgactctctgagggcgatgggggatgccgaaggcattggctatcaatagccaaatggtatatgcccatggcttctcctacccttgtcccaagagaggtgatattgagaacagccacatacactggggggaccaccttacttaattcctagtaatctactgttattctttgtgtcccatcaggcttctgcatgggccattcagggctgttgtatgggctgtgcactggccttatagtgcctgcccaggctaactcccatatagtctctgtgatttcatcatgtccccacccttgcaggtggtattgctcagcacctctactcacggcagggctggaaagtgtcctggtgtccattttgcattctctgatcacagggttcaccacctaactctccgtcagaattcccctgcagttgtttgtggggtcaggcctgataagttatctactcccaagatgtattctgggatgggagcaaactataattagtctacaaaatgttgaccatttaaataaaaaattttctaatgtattagttgtaaaagtgcctcctatcacttcatatttttaattaatacacttagttttaatgtcttttatctgttctccatgtactctcaaaagtatctttttcaatgcgttccactggtttattttctctctgcctcactctttatctgttcattatttgtttatttatttatttatttattttgaggcggaatctcgttctgttgcctaggctggagtacagtggcacgatctcagctcactgcaccctctgcctcccgggtttaagtgattctcatgcctcagcctcccgagtagctgggactacaggggtgcaccaccatgctcagctaatttttgtatttttagtagagacggagtttctccatgttggccaagatggtcttgaactcctaacctcgtgatccatctgcctcagcctctcaaagtgctgggattacaggcatgagcctccgtgcccagcctgttcattatttattatatgaagtgtatagggtagtgattaagaccagcaaaagttctggagctattgactgcctgagtttgaatccatctgtgccacttactagctctgtttcccacgtgtacaatagaaatagtaataatatttaattcatagggttgttgtgagaattaaatgagttaatatatgtcaggtatttagaacagtaaataccttacagtaaggttctcaattatcttagcctgacagtaagttcccagttgttagccattttcatttttatataggctaattgagccaggcttctttcagttttcctcttctttcatttttcagactggcaccttagtacccagagttcagcagggaggccaggaaccttgttaggaagtagggagaggggagaagtctacaaatactcataatgtaatatccattcttttatctttgtcacatctaattataaaaacaaagacaaaagaataacttctgacttttacatgtaaacagatttagccctatattgcttccccctttcctcctgcttatccaactctcacatatatcctaagattttaatagtttttcttcaactgtgtaataatttttaagtgtgtttatttgattttagtgtttaccacatttcctttaatactgtaacccaaattatatctgaagtagtggcccatgagctgtaagggaaatgtttaaatagacagattttgagatttcaaacaaaatctccagacctgaattctttgatatcctcattcccaggagattgtgataaatgccaggtttgagaaccactgttttaaccaattgagaaatgaaacaaagtgaaaactcaagactggtgagggtagttggggagagtggtgatgtggttgaccattctttctctattagcttggaagatctatattctagctctcattctacatctctgactactttttcttcattttgtttgttccagtttttaaaaaacagatcccactttctcttaaataggttccccgccccccaacccggagtctattttggtcctctcttcctttgtttgctctcttagatcttaatattaactctcacttttctgcaagcctgttccccaagcctgttatacctcaagctctcaggaaaccgaggtcacattttcaacttgtctaaattctgtatctctgaaaacaaacccttcccctctcatctttctctttcattcattatgtattctctactcatcacctgggctccaccctcttctctttctactgcctctatcaaaattcatgctcatttctgttggaatgcactatagtgtcccctccaccttctgcctctttagtgcatcccggtatcagattaaccttcctaaaatattattccattatagtgtaatgattacacaatataaaaaaaaacttttaggttcgggggtacatgtgaggatatgttacataggtaaattcatgtcatgggagtttgttgtacagattatttcatcacccaggaattaagcccaatacccaatagtcatcttgctcctctccctcctcccaccctgcaccttcaggtacacccatgtctgtcatttctgtctttgcgttggtaagttctcttcatttagctcccaattgtgagaacaagccgtattctgtaacacaggttttctgttcctgcgttgtttgctaaggataatagcctgcagctccatccatattcccacaagacatgatctcattcttttttatggctgcatctgtcacacaattcttaagctcaaaatctttcaatgattgttcagtttatatagagttcagattattcagcttgatagccgagaacttccaaaaatatctcatgtactattattatatctcttattcctaatatttctctttactgccctaaactctatcaactggaaatgctccctaattaagggccctcatttcccctctctgtgttctcatccatttctctgcctagaatatgttttctgctttacttgtcctataaccttagcttttccttcaaagctcatttcaaatgccacttgctctaggaagttgtccctgagtaccataggtgcaaatggtgtcttcctttgaattctcatagattttatctgtcaagtgagtaaagacacttcacatttttttcatttattttcctgccgttattttaattttaaaatgtactgactacattaattcacacaattcaaacaagtaaaactatgcagagtgaagagtgggagttcttcagtgctttgccaaagccattcccatacctacaggaacacagcattactgtttagtatactatatccttctaagtcagtagttctcaaaatgttcctggtaaactccttgcttcaaaccacctggggagctagttaaaaatggaggtgcctgtgcatcaacccagcccttccgaattggaatctcttggaagtaggaactaggaagctgcactttggtcattcttaatcatactaaattttgagaatcatcccttttatctatgcattaaataagagttcttttacaaatgtataattttgtttttttgtttggttgttatgttccttcagtaatgctattggctttcttttcatttttagcaatgcatctcagagatattcataaaacaaatgtagagacgcactgtgtgtgtgtgctttttaaaaaatttttaaactctatagaatacatttaccaagattgatatagctatttttctgttgatggacatttaggctttccagtttttaattattaagaacagtgcttcagtgaatgtgtaaaatttgcacacatggtgataagtttatggagtagaagttgctgggttaagtgcatattcaaaatgcttatgctgctaaattgttctccaaacaggctttttgggttcataccaaatttccaccaattgtgaaagagaatattcatatccccacaactgtaatcagtagtacatcttatttttcagtttttcaggctggtggatgaaaaatagtatttccttgttgttttaatttgctcattttttcatgactggtgaggttgagctcctgattttcttttttgccatttgtatttccttttacatgaactgtcagttctcatttttgttcatggttattatttattgaattgtctaccatcagtgctattgaactgtccattatttgtctactgatttgaaatgtcatgtttgtcatactaacttcctataagtacattgaacagtttctgaactttttattctcttcttttaatgtatttgcatttatctcctatcatttatattatggtagctttgtagtttgcttttccttctttcttttttttttttttttttttttttttgagacagtgtatcactctgttgccctggctagagtacagtggtgcgatcttggctcactgcagcctccgcctcccgggttcaagcgattcccctgcttcagcctcctgagcagctgggactacaggcatgcgccaccatgccgagctaatttttgtatttatagtagagatggggtttcaccatattggccaggctggtctcgaactcctgacctcgtgatccgcccacctcagcctcccaaagtgctgggattacaggcgtgagccactgcacccggctttttctttcttttttaattttagagacagagtctcactctgttccccacgctggagtgcagcagcatgattatggctcacggcatccctgatctcacaggctccagaccacaggttcatgccatcatgcccagctaattatttatttttggtagatatggcatctttctatgtcgcccaggctggtctcaaactgggactcgaggggccctcccaccttggccttccaatgtgctgggattacaggtatgaaccactgtacctggcccatagtctgcttttatatcatcacctttattctttttcaaaaaatttcttggttatccctgtccattttttctttcatatgaaattttaattagcttataaaatccatacaaaattgtatttgaattttgattgagactgcaatgagttctaggttaatttggggaagatttgacaattttccaaatcttgatatctccccaaagcacagacatatttttgatgtttagtcttctcatcaggaagctggcagtctctgcagtcttctgttctttagtaaagttttagtattttctttaaataggtctcaaaactttttaaatattttgcttattgataagtatttttataattgttttgtttttgcaaacttgaataggattttttccattatatttgctaattggtttttgctgatttttaggaaaactgttgaagtttcttgcagttctagtagtttttcagccatttcatttacacttttcagtcaatgatgccatctatagataatgagtcttgtctcttcctttccagttattgtaccccatttatttatcttatcttactgaattagctaagtctgttggctcaacattgaacagtcatggtgagattgggcaccatgattcttctgtctttaatgaaaggctactagtgtttgttaatcaaatatgaggttttctataggtttgtggtagatgtcttttgtgatgttaaggaagatttcttctattaatctgagttaaagcttattatatggaagtgttaaataaatgctttttccagaatccagatgatcatttgagttttctctttaacttatatgttaatttggtggatatagcgacttacattattacttacctgaattcactcttggaaggaaaagaatcctcttgggtagtaatgaattgtgtcatattacttttatgtgatttcttagtattttatttagttgtatgacattaagttgtaagtgaaattagcctgtgaataggcagactaatggcctcacaaagatgtcctaattcgtgaaacctgtgaataagctactttacatagcaaaagggatgttgcacatatgagttaggttaacaaatttgtgctaaagagattattctagattatctacattggcccaatcaaattgcacaagtccttaaaaagggaaaacctttccagctgcaactagagaaagagatgtagcaacagaggagagttcacagagatgtgatgtgagaaggacttgtgctgactttactggatttgaagacagaggaagtgtactatgagccaagaaatggaggcagcctctattagaaaagacaaggaagtagattctcccctagagcatctagaaaagaatgcagctttgttgatgccttgattttagctcatggagacccactttggacttctgacctacagaactgtaagataatagatttgtgttgtgttaagccgggaaagtttgttagagtggcaatagaaaattaacatagcctatggtttcatctgtgtgctctccaagtttagaaacaaaactgtagctgaaaagttttctttttcaatgctttaaaacagacttcaaaaaaatcatttaagtttgataaaattaagctgttaaacctggctcttgtgcctttttaaaggagaaaatatttgattcttcaatttcttttgtgacatcttttcctaaacatgtgttataattctcaagtatatattttgtcttccccactagactggaagcttcttgaaggcataatgtgtctgattaatcttgctatctaacttagtacctaaaataatcccttacagtaatgcaaacatttatatagatatcttattcaactttgcatcctcatagcactatatacagtgtctaatgtttatgaaactaatttcaaaaatgtatggtaatttagacagcttaattgattaggtaattcagataatatgctgagtgaacatgagctttgaagtcaggcctgagttaaatcctggatgaaccactttcctaactctgtaaatttagacagttgattaacatctcaaagattcactttcctcactagtaaaatggtaagtaaaatcctcacttattttatagtgaggaaatgtttgtagagtgcttagcacaatactggataggcaatcgtcgctttatgttagtaagttatgaagataaaaaatgttatttagaatcaaatggtattttataaaaatgttactttttctgttgctcctgttgtaattttttaggctgttgtcatgtcaaaaggggatactaagtttccaatctgttcttgagtatacagtaatgcggtcaataactttagttggtgcctccaacaagtattatccgtggatgaggttacatctgggtactttggaatatgatagaagcaacatctggtgtgcttttatacagctcatgaagtcagtgctttagaaactgaattaaaatgtttcaagggttttcttcctatttaatgctgtgatgttgctaatcccgtcctcctcttaaagctggtgatcctcctcacattaacggccattgatatagtttggataattgtcctcactcaaatctcatgttgaaatgtaatcctcagtgttagaggtggggccttgtgggaggtgtttgggttatgggagtggattcctcatggcttggtgccttcctctgggtagcgagttcattttcacgagatctggttgttcaaagtgcatggcacctcccctactctcccttgctcctgccttcagcatgtgaagtgcctgctcctgctttgccttctgccacaagtaaaagcttcctgaggcctctccagaagcagatgccagcactatgcttcctgtacagcctgcagaagcatgagccaattaaacctcttttcttataaattacccagtcttgagtatagcaatgcaagagtggcctaacacagccatccttgatatttatggaaccctctcaggcttaatagttgactcaagcacaatgaataagtggtcccctgtctttgtgaattcatagataaaaagacaagacaatcttgtgttgtgacttgttttgtagtttccattgaaatcttgtagggtaggttgtagtgaagtgtgtatcttacatcattttctgggaattcatagggaagaaaaattgaagataagaaaatttaacactgattttcttgctcaatatggttctaaggagttgatatcagattttgaattgggtggtgatggtggagatgaaacagtgaatgtgtgcagaccaggcaagactgaatgaagagaaggaatggggctataaaagacactttgccaaaataaataatagtcactatatgtcatatccctactatgtgacaagattgttatctgctttatagacatcattttcaaacctatcgataaccttgcaaagtgaattttttggataaacaggccctgaggagaactttgccccagtaagttttcatagggttggtgatgcaaatctttctggatacaaaagccagtggaaagtagtacaaatcacgtatcccttatacgaataaagaaactgctggagtaccacttctctcctggggttgaagagatcatttaggtaaatactccttttaaagatgtaaaagctaatgatggtttacaaacttaaattcttacactagcaaggagtgggagctggccattggagagagagtactgacggacgtggtaagaaagtaggatttcaggtttagatataattcattttaatgaatgtgtgggaatacacagaagagaaattatatggctccaggttacttagtattgatctaagcttcagtttatacaaaccaatttagactttcctgaagtataaattgagttatatcttaattatgagaacatattaataaactaattaatataaacaggactagactaccccaaaagattcataaactaagcagcagcagtggccctgtatcatcacagttgcattttggaaggtaaaattaaccatttggaaatatgtattccatcaccttctttatgcaaggtacttatttaggctgaagacacaggacagaaaagggctttgcccatatatacagatgaacatggacaaagataaacttcagataattagagctatgcagagactttatggtattgtgaagagacaattttcgattatgtgtaataggaaggtgtcccagaggatgtggcatttaagcagagatttgaataacaaaaacaaactagccatggaaataaaatgtaggaggaagaaattctaggcagagggagtagctagtgcaaaggtggtcacatgatgtgtgtgggtgtgtgtgtttccccctaggactctaacacagaaggtgaaggagagaatggtgggaagttgcattggagaggtacggaggggctgcatcatttacatttggcccctttatgataaggggtatccatattaaagtaaattgcctctagatgggttaagaacagtgtgtcataaaagtcaagtgaacaggtttcatttatatgtaccaccagatgctgcagtgcaagaatgttttctgtaatgtttgtttttattttttgccttgtattaatgctagtgtatttaagtttccactgtcagcccctgaagagcagagcagacatctgctccttctagtacctaatccagtgccatagcacagaaattctcaactagtgaatcaatattgattggtgtagactagttaactatgttattgccacaaatgacatctaacctgagctagttatcccacaaatagtcctcacagttatgaaaagggaaccacagtgtgtgatgttccccttcctgtgtccatgtgtccatgtgttctcattgttcaattcccacctatgagtgagaatatgtggtgtttggttttttgtcctttcaatagtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgtcttccacaatggttgaactagtttacagtcccaccaacggtgtaaaattgttcctatttctccacatcctctccagcacctgttgtttcctgactttttaatgatcaccattctaactggtatgagatggtatctcattgtggttttgatttgcatttctctgatggccagtgatgatgagcattttctcatgtgtcttttggctgcataaatgtcttcttttgagaagtgtctgttcatatccttcgcccactttttgatggggttgtttttttcttgtaaatttgtttgagttctttgtagattctggatattatccctttgtcagatgagtatattgcaaaaattttctcccattctgtaggtagtctgttcactctgatggtagtttcttttgctgtgcagaagctctttagtttaattagatcccatttgtcaattttggcttttgttgccattgcttttggtattttagacatgaagtccttgcctatgtcctaaatggtattgcctaggttttcttctagagtttttatggttttaggtctaacatttaaatctttaatccatcttgaattaatttttgtataaggtgtaaggaagggatccagtttcagctttccacatatggctagccagttttcccagcaccatttattaaatagggaatcctttccccatttcttgtctttgtcaggtttgtcaaagatcagatagttgtagatatgtggcattatttctgagggctctgttctgttccattagtctatatctctgtttttgtaccagtaccatgctgttttggttactgtagccttgtagtatagtttgaagtcaggtagcatgatgcctccagccttgttcttttggcttaggattgacttggcaatgtgggctcttttttggttccatatgaactttaaagtagctttttccaattctgtgaagaaagtcattggtagcttgacggggatggcatcaaatctataaattaccttgggcagtatggccattttcacaatattgattcttcctacccatgagcatggaatgttcttccatttgtttgtatcttttatttcattgagcagtggtttgtagctctccttgaagaggtccttcacatcccttgtaagttggattcctaggtattttattctctttgaagcaattgtgaatgggagttcactcatgatttggctgtttgtctgttattggtgtataagaatgcttgtgattttgcacattgattttgtatcctgagactttgctgaagttgtttatcagcttaaggagattttgggctgagacaatggggttttctagatatacaatcatgtcatctgcaaacagggacaatttgacttcctcttttcctaagtgaataccctttctttctcctgcctgattgccccggtcagaacttccaacactatgttgaataggagtggtgagagagggtatccgtgtcttgtgccagttttcaaagggaatgcttccagtttttgcccattcagtatgatattggctgtgggtttgtcataaatagctcttattattttgagatacatcccatcagaagggatagcattagtagatatacctaatgttaaatgacgagttaatgcatgcagcacaccaacatggcacatgtatatatatgtaacaaacctgcacgttgtgcacatgtaccctaaaacttaaggtataataataataataataaaaagaaaataataaataaaaagggaaccacaaggcctactagatcagtgaaaattcatttactcaagacaactccaagtacataatgtcttaggtaatactctatataaagtggtttgtcacaagagctgtgcttgctttcttttgaattttatgcttcacattctgtgggaaaatgtattacacagtatctcacagaagtattactattaacctatatttacttataatactatcttctatagcgtgatgttaaaatttgataaattttagggaggaaaatgtttgtctttctttttttctcagacaagctcttagtctgttgcccaggctggagtccgttggtctaatcttggctcactgcaacctccgcctcccaggctcagatgatctttgtgcctcagcctcccgagtagcgaggactacaagtgcatgccactgcgcctggctgatttttaaaatttttgtgtacagatgatgtctcactatattgccaggctggtcttgagctcctgggctcaagcgatccgcctaccttggcatctcaaagtgctgggattacaggtgtgagctaccacacccagcctgttcattttattataaataatttgttggaactttctcagttatagaattgatgttagcagttcatttaaccgtaagactaaagggatggtttgtgacatcctgactcccattctgtatctcttcattccaactggcaccattccctaggcccacagggtcttccccactgccctcccctccccccacctgccctcaccttttctggtcacaagctccagaccattccactttcctatcaaaatatgtcttcttacttccaaattcccaagtccctgttctacttccaacacactgtactccagtactttaatccgtggtaatgattcagtggagccagagaatataaagctcattatacagttagttaagctgttaggccctctttctgtcttaagcatctttcttcttgcagacagtctcaaagatttttccttcttccagtaatcacccatttatttccaaggaatgtttcatccatgcctagctttaggaaacatgttattgcttggatttctattgaaaatatgtgtggcaatttggaaaccattttttcctgacttcattattctttcatgttttagcctgtcaatgcaaactctattatccagagatgcattatagaacaggagtttaagggagaaggaaattaatattggccatggtcatgttcgtattctttttccttgtagaagacaacaggcatagctagagtggcattagctaactgtaaaaaggatttgtagggctagggatgaatgtaaatgtaaacaacttaaatgtggattctattatagcttcacatagagtatctgtgaccacaaatcatattcttctcagtagctgatttcccacaccagttcaaagggctacagaagaaatactgtcatcaggacactacgaatagtttacttggatatatgcaataaaaggatgcaagtatattttctcgcattttcttcctaaagagttgcaaacagggctggatctagaaaatactgtttcctttttttggggtaatgctccctgccatttttatggtttacatgggcattccaatccatcaatagatttgttttacagctttcaaattattaatgacaaattcaagaaacaattctgcagtcaatgcctatggtctaattttttgtagttttcctttaacttaaaaaccatagaaagaagtaccatctttgatactactgatgggcccaaacttaaaaatttatgatgcaaaatagttttagctatcatttatgattactaaaaacaaccattgacaataaatattttatactatcacaaaaagcagactagctttctcataacttagcaaaggtgttatggttgaaaataaaattcaaaataagttgaactgcttaactcataattactaaaagttcatactctatagtgccatatgtaacaagattctcatttaaaaaaatagatgcatactaatttagaaactactgagatggttattttccttttttgagacctagctgtcacccaggctggagtgcagtggtgtgatctcagctcactgcaacctccgccttccaggttcgtgcgattcttgtgcctcagcttcctgagtagctgggattacagtcacatgctgccatgcctggctacgttttgtatttttagtagacatggagtttcatcatgttggctaagctgatctcgaactcttgacctcaagcaatccacccacctcggcctcccaaactgttgggattacaggcatgagccacccagaaaactactgagattctgaaacaaatttagaaaaaagcatacaaaccaaagtttaaggtacatttaaaaggctttccaattgttgagatttccatttctctgccaagagaaaaacagggtttagaaaaaccagcgtatctccttttacgcatttagagatctttaaattgttagctattgtagcctgcttgttcactgggttttgtagtgtgtatatatataggccaccactaatatacttcgggagctttgcattcacagtagctcatggatatgactttaacatgaattatcatactatcatggttatggcaattcagttttttttaagaataaagttattataatacaaacattccttgtagtaaatgtttgtattatgggttttttttttttttttgtaacaaagaatttgttttctacctttgttatcatttaacaagcaatttacaaaaccaagaaggaaccaaatctttgatttacatttctgctgacctagtgtgtggactcttgcagaggaatagcattgctgcatagtgctcagaaagtgtgggaaaacggaacaaaaagcttgaatccatttttttttctgcttttacatcagaatttatatttaggttatactttcctagaggaatgaacaatacatctctcttatccacaatgtgtaatttgctagttttgtgtttaaagcttttcttatttcctgttctacttctgtgaattaaggattttaagcaggggcaaaactgtagcatcagcaggtaatcattcttggatacagatactaagtacatgtagcatgcttgtcttcactcttaggtcataagctccatgagagcaggggacaatgatcactccaatccttgctgctttcccagcatatagcacatggcagaattcaaacatttgtttaataaacaacaacaacaaaaaacctttcatatcatgaggaagacatctgctgtcctgaaagagctgataaattatgtagcttacttaaaaaaaaaaaaagaatatgatatggttgacatacaataaagtagaatttatgctgttgccctgcttctgccataaacatgacaaaacatgacaatgggaagtcacctgagttctctggatctcagtgaataaatttatgacattaagggatttaacaaaaatgaaacccagtgggaaaattgtacaagtcactcaagttctaaattgcttcccaatgctgaaatcacttagtgagatacatcaaagaccacagaactttcggtttacaagtaacagacaaagaatactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgta

SEQ ID NO: 198 - DNA, 11004 bp, Homo sapiens
agccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaa

SEQ ID NO: 199 - DNA, 357578 bp, Homo sapiens
agtccattttcttgacaaagatttgacgattgaaactatttattagtagccacctacagagctccaataaataatagcaaacccaaggtaaacaggattctttaccctaccacttttctaagataccaccaaaatgaaagaaaggaaggaaggaaggaaggaaggaaggaaggaaggaaagaaggaaggaaggaaggaaggaaggaaggaaggaaggaaggaaggaaggaaagaaagaaagaaggaaagaaagaaggaaagaaagaaagaaagaatttagtaacagaagatgctacctgatttaaaccctcaaaaaatctgtgattcaacttaaaaaaattaacagaagaaaatagctctctaaagcaaagcttttagagtttattttagaagaaggtggtagtgctacattattttttaagtaatatttacagaacagtttgttctggagttctaaatgacacaaatagagcaggcctggtgtacacacaccaaaatggtgacaacgaaattagggcttgatccggtgataaattaccctctgctcatctcacgaacacctaaggctccaaaatggagaaggcatcatttgaataagtgaaccattggctacaaataagggcacacacccacttacccccaccaaccctccacatacaattacccaatctctaagagaaagacacgctggctctataattaccagatgtgaactaagaaactatgcccttttaaaagcttagctatatttcccaatcacactttactcagcctcagagcaaactccaaagcagtatgatgcctgctcctgaaaagtctaaagggaacaatagacagcagggcctacttgagggttgagggtgggaggaggatgaggatcgaaaaactacctatcaggggccaggcgcgtggctcacgcctgtaatcccagcattttgggaggccgagacaggcagatcacaaggtcagcagttcgagaccaacctggccaacatggtgaaaccccatctctactaaaaatacaaaaacacaaaaattagccaggcttggtggcaggcacctgtaatcccagctactcaggaagctgaggcaggagaatcgcttgaacccaggaggtggaggttgcagtgagcagagaccacgccattgcactccagcctgggcgagacagcaagactccgtctcaaaaaaaaaaaaagaaaaaaagaaaaactacctatcaggtactatgcttattacctggatgatgaaataatatgtacacccctgtgacatgcaatatgcctatagaacaaacaggcacatatacccctgaaactaaaataaaacttaaaaagaagaaatgtctagcccagaacaacgtccaaatctacctgctgggggacaaagcaatatcactgatgctagaatttgggggacaggaggtggatataatttcatattccttatcccaacatgtcactgtgtgttattagtgcagaaggaaaaaaataaaatttttcacagccaactgttttgtttagcttcaacaggggcttattgtcaactacaatagaagctggcctatctaaaatctgcaacctcactttccaagagccaaaaaggaatttgtaaatggcctctgcagagttcacacggttggcatatgagccttattcatatagtaggccatgcctaaagactccatggagacctattgtatcttcagtctgttgactcttacttgacacaaaattctaaccaacctggttgattttaaagtttacagctcaaactcaggaaattccagtatgaagacaaatcaaaggcacttggaaaagaagaggatatatatatatatatacagtgaaatgctcatggtagagacaccaaatgctgaagagagagatgcattaaagaaatgaagaagagtccatgagcccattgctcaaagaaggccttcaagggacagtgcaacttgtcaaaagccagaacagactggagccaagtaaaaaaggagagcatggaaacaggcagtacactaggatcaatagaaaaggaaccaactggaacaatccagagtggcaaaaaggccatgattctcatgctgttggagtggcagctgatgtttatcatggacttacacattcagtcttggtgcaaagtgctttatctgctttctcttattcaatactctcagcaaccctatgaagcaggctttatgtaaattttacaggtgagactacaaaagcttagagagttcaagcccaaggtcaccttgctaggaagagggatagccagaattgaacttcaggtccgcctagttccaaagcctgccctggggtggaggagagggagaggcagacagaggaaagaaaaaggatgatactattaatggtatttaataatattttgttacagcagcctaggtaaactaacaaccccatttaacagatgaagaaacagagcaattctttaaaacattcattctaaaaaagaagaaaaaaaactttcccagtggaagataaaactaggggtatttgacaggcaaaatgactccccttgtaacagaacactgcgaaggaaaattaagcagaactactagatgacataaaataactgaccatttgtacgcatcctttttctttcttttcatatttgaaataacataacttgcagtaagatcagcaaagggaaaatctctgtaacaaaatttcatttatagaccatacccatgaaaagtttaagcttgacactgatacagggcagggcatcatcacctgaaagaaagggaaagagagacagaaagaaaaaaagaaaaagaaagaaagaaaactaacaacccagaaaactaagcagctcattacatgttctcttccaaattctgtagaaccacacttgaagtgacagatgtgaagaggaaggaggttcacactcagaaaggcaggagaactattttggggaggtttgttggaggaggtggcagagtgcctagagaactagtgcacagatgtagctctggcatgtgtatccatccattcattcattcatgcatacatgcatgcatgcagccaacatttactgagaccctactatgactcatcaacagaagatggagatactgtagggaaccagacatagtctctgcccttaagaaactcacaatctgctgggcaattacagacacgtaataagtcaatgaatagtcctcataatggggactttaggaactaagcatgagatacagggagtagaggaaggcttcttggatgtgacatgtgagtcttgaagtggagaataaccaaggaaagaagtggaaggaaggctggagagattaccagggacagggttttgcatgccacaatgagatctttacattttatcctgaaaggaatggaaagccattcaagattcattatccggataattacatgtccagattaacattaaaaaataaaaatctagagacaatgtagataacagcgtggaaagatatttagactggaggcaggtcaagagactactgtattatctaggctagaaatattaaaacctaaactaaggtggggatgggggaaagtgaaaaagaggaaaccaagttaagagacacttaggagacagcatcagtaggcatttggcactgatttgtacaggggttacaaagaagacaaaagaagaatggcctcaaagtgtgtgatttgattgtggtacagctaggatgctggagacattccctaagaacagaggacacaggacaagattgcggggaggtggcaagctcagacttgaacatgttgaatttaaagtgtctttgtctggaggtcctagtcattggtgtctctgtgttgcacccactgtattagttatatattgctacataaggatattaccacaaatctagcagttaaaacaacacacaaatatttatttcagtttctgtggatcaggagtctaaatatgacttagccagttcctctgcaagggtgtaatcaaggtgtcaggcagggttgggttttcgtctgaagttcaactggggaaggctccatttcctaggtcacatggttgttggcaccattcagtactttgcagactgccagactgagggccctagtttcttgcttgcttttgattggagattaccctaccctctttgccacatagccctctccataggcagctaacaatgtggcagctttcttcttcaaatctggcaaaaaaaagaaactccttccaagccagacattacaatcttacgtaacatgatcatgtgcatactatcacatttgccatattctactggttagaagcaagtcacagagcctgcctcagggcagaggatcacaaaaaggcatgagtctaggaggcaagggtcatggggtctgttagagtctgttagaagggtccttagagcctgtttcaccacatccattttcatttagtctccaaaagttagaaacccttagacctgctttcttacctcctatggtcccatggcctaagcaactagatactgaattgtatgcaaatatagatctacaacccatccatccctctcagttcaatctctttcatgaagctgtcccaaggaggctctcctctctctctctccattctgatctcatagcacttaaaatctaaagtaatggcttcgagaatttgagtgtcagaaaactaaatatcccccaaaaggaaccaacccaaatgtccatcagtgatacactggattaagaaaatgtggcacatatacaccatggaatactatgcagccataaaaaatgatgagttcatgtcctttatagggacatggatgaagctggaaaccatcattctaagcaaactatcgcaaggacaaaaaaccaaacaccacatgttctcactcataggtgggaattgaacaatgagaacacttggacacagggaggggaacatcacacaccagggcctgttgtggggtggggggaggggggagggatagcattaggaggtatacctaatgtaaatgatgagttaatgggtgcagcacgccaacatggcacatgtatacatatgtaacaaaccctcacgttgtgcacatgtaccctagaacttaacgtataataaaatatatatatatatataaagaaataataatagctgtcatgtattaaatgcttactatattttactcactatactggaaaccaaatatgcaatatctcatttaatccttataatgataataaattaagggtacatattattccaattttaccaatgggaaaactgaggcatagagaggctaagacactcacccaaagtcagatagctaataagtggcaggaatcaggcagcctgactccagagcccacactcaaagctagcccaggcacttagatatcaccagttacatttttacgatcttctgaatgagaaaatacaaaatagctaaaagctactttgaatccagtaacagttttaaatacaattttccaacacactagtatctacaaacatttgcaaaaagctgtatgtacatgtgcaagcatttattctctccacagacaatggggattggcgaccattcgcagagcctcacagcccttcctacatggctcttcgctgggcaccagttgccactgccacattcttttggtacctggattgtaatgtacatcagcaattctcaaacaggggcaattttgctcccaggagacatctggcactgtctggatacattttttattgtcatggttagggagggggtgctaatggcatctagtaggtagaggccagggatgccgctagacctcttacaatgcacagggcagtcccccataacaagggattatccagcccaaagtatcaatggtactgatcttgagaaatcctaatatgtatcactgtaaaatgctctacttctctcatacatatttgtcctaactctccaagataaacctctatgccatcagagcaggaactacatgatacccatgtcactccacctttcccagcctatgcctaagttcccaaacacgggaagtgtccaagagatactttttgaattgaaatttatttcaaagaaattctaggctttacttctacaagacctagttattcaatgattaacacattccctccaaattaagaacttctagtttgaatttactgaaggctaatttacttctggagttaacacagccctccccagcagcctccggcacctgtatgtttgaattagcaaataaatctctggtttagaaaaatcagataaatgaaacaatatgcagaattgagacaaatagggagatacagaaacatcatcaaatgccaaggactggaaggtgcctatttcctaatgcaaccactctccccttaaacaaaggcaagggcatgcaaatgaactagggtccaaaaatgatccttttcttttttaatcacaaatcattgtgagtgaagagaacattgttctgaagcacatcagatatatttgctgaatgatgaatgagcccctgttgtttgttagcacaagtgggagttatgtgtatattaagatgagaacacactataattctaagaaggaaaaggagctattatttcacctttttttttcttgttttctttttctttttcttttttctttcttttttttttttaacacattctcactctgtcacccaggctggagtgcagtgacgtgatcacagctcactgcaacctcgacctcccaggcccaagtgatcttcccacctcagcctcctgagtagctgagaccacaggcatgcacatcatgctcggataattttttttgtaaagacaggatcttcccatgttgcccacactggtcttgaatttctgcactcaagcgatcctcctgtctcagcctcccacagtgctgggattacagcgtgcgccacgacacccagcctatttcacttttcaacatacagaaatttaaactcatattccagacgatgagtcagatgactcctccatccaatgaattttgtacaatgtaggcaaatattgcattgtgtatttccacacctctatgactcaatcttagggtaaagtctggttcctctttccctctcagataaacaaaaaacaagtccattgaatcccagaataacttgaaacctttgggacctgcctacactgctgagaaggctctgaaattgttctgtctgctccagcaccgtactttccatggagaggtgatgaatcagactggacaggaccacagggtctctgaaattcctcaggagaatcttgattacacccaattagtgagaccatatacagaagcccggtgaatcagacggcctcacaacccagcaggtcagcagggctagaaaaccaaggccattagctcctgctgtgtcctacctctcaaagaatcaaatccaagctggttgtgaaaaacaatggccattttatacaatcagtcccagattatttttaagggggatgtgagagattcaaagcagtggagaacaccaaagtcactaatagtcacatttagaatccaccagaggttgttttttgaaatgaaaaatctgacttctcaaatacaattttcctaggctgatttaaacatttctcccaagctctctgggccaaatagcatcagaaaacagtaatacaggtatgtacgagggcctggggtaaagtggcctgggctgaagttcatctgagcattggcctggttctataaggttggtaagctcatgtaggtggacggagcccctggctaaggcctggttcaaagtttgagttggcatgtagttggcatctgactataccctgtcgttcattcattcacatccgactcctgagctcagacctcaatacctcccaggagttagccctctcttgattcattccacctacactggtcaagcatctactctcacatgtaaggcctttattctggcctttccttcctttcctggtgcctacatacccagattttacgcattctccacaattctgtggtccaaatccaagtgaacctcctctaagaagctaaccctgaccaactccagctaacacagtctcacaatattctctggataccagacatcagagcagctgtttgttgagctcagatgatactccaggtaccatgcccaacatttcacataactgatctggtttaattttcctatgctgggtaaatatcactacccccactttattgatgagcaaactgagactctaaggaaaagcatcttgcccagatttcacagctaataaataatggagctggaacacaaacccacaactgtctgacagtagagtttaggcatgaaatcaggggtcagccaactcttctgtaaacaagcagatagtaaatattttttgcaggcctcacattctctactgcaacctctcaactctgcctgtcattgtagtgcaaaagcagccatgcttctatatttcaaaatgaaaaatctatgtttctgtatgaaacatcctcctgcatagagtcaaagggctctaagccccttagcagttctcctctcaccccagtgcacacagctctggacttacccacagtaacagcaacctttactgggggcctgttagaagccagactcttcccaaagacctcacaacaatccttacacaaggcagaggccattaatttctattctcacgtgagccaatgagctttgagaagtgaaggaacttcacaagcttgccccagcagtgaggtgtggcctggaacttgatcccaggcagtctgacttaacaaccacaacttccacctctacagcctgcataggcccaggctgactacagctggagctggcacctcttcagcttgagctcccagcacagggtcctggtctcctggatgctctgctgcccatgtgtgtccacaggagaaagttacagggttgctgcagcctctggcttctgacgtgggtctcacagactggcagtcagacctacagagtgtaccgctaatggctttaaacaagcagaaatcatattcagctaactaaagatcaagggccattgcaaaacgcctgatttcatattccattgttaaactttaatgagccattacatccactggaatgaatgatctagtatgtcatatcccataacataatttttaaaagtctaaataaatactgcaagcctcaaggaaatcacttcacagagcctcttccatttatggcccccactccaggtgtgcctgaatctattctgaggcaccaacctgccacatcaaacgacatcatccttataatgtttccttttccaccagactccttctgccctaattgtgcaaataatggataaagacaagccccataccggctaagcagagaaagggggaatgggtcctgataacaaagtaatcaatccttgctctccctgtgggttgatatgttttccagtggcgcatacatgagtttcagagtcagaaaatgagtttattgttggaatgaacttgaaccttagtaatcctcaggttcctcatctagaacatgagaacagaaatgactatggcataggtttctgattacaccgaacaatatttctaaagtgactgacccaagcactagtccccatcctcctctctttcctcttatatattttatttttaaaccacatgaaatggaataattatcatagtgtctgttgttttactttccatacatattcttttaaacttccaaatagttcctagcatgaagtagaagaggcactatgacataattatgttggaaatgcctacagaggtggtcttctgagttttttttaggtctgcaattaagtgtatgaaatagttaataggtcaaaagcctacttcaatctagcttacatagtcagtgtggtacgtaatgcaactatcacctaactgaccacacatagcttggtttctaaaaggcaataacatccaaaaatgtgcaacagatacacactcaggctggtggcttaggccagggggcctaaagccagattcctcagttcaaatctcaactctgccacttagtaactgtggatgtgggcaaatctgtagtctctccaagccttggtatcctcatctgcaatatgggataatggtgcttgcctcatgagcttgttgtgaggatgaagtgagataatccatgtaagacgtttaatatactacttgactccttgtaaggattcaatacctgtaggttattattcttagtgtcactattaatgctgacttgtcatcactgaggtgatcctaaagaatatgcaattctggaagaagagctgaaagagaatgaaaagcaataaaattgcagagcaataaaatcactgggtagggtagatggcctaaggtgacacttaaggggctaactcagttgacagaaatgtattttaacatgtgtgtacgtgtgcatgaatttgcaaaagtgtacacatgtgcaaaatctggcatatctgctaaaagccccatcacaatatcatcatgcctcatgtatctaaccagagtggggagtctatcacagaacaactgtcaagttaaaactggatcatcactgtccaaatgaaggcaacttctcaatttcctttttcctttctctacttcttgtcaccctcccacaaatgaatatgattacccatgccaagaatatacagcttagaaataagatcaggaagaaaagcaaaaatgaaaaagaaaggcctaggagaacaggaaagcagagaaagtgattaaaaagcagaaccacttgactgacaatcattcatacaataaacaaactctgtcagctgctctacaacaaatattctattaactgctcaatgttgttgtctctaattcttagaaccagtgtacaaaatagacattattattcccattagacagaacaggaaaccaagacaaagtgacttgcccaaggccacatggccagtgtcttagtccatttgtgttgctataaagtaatacctgagactgggtgatttataaagaaaagaggtttattcgactcatggttctgtactctgtaaaagaagcatggtgccagcatctgcatctgatgagagcctctagaagattccacccatgggggaaggcaacggggagctgcatatgcagatcacgtggcaagaaaggaagcaagagagagaggatggaggtgccaggcttttttaaacaaccagctctcatgaaaactaacagagtgagaacttactcattactgtgaggacagcaccaagctattcatgacagatttgcctccacaatctaaacacctccccttaggccccaccttcaaataaatttcaacatgaaatttggatgggtcaaatatccaaaccatagcagccaattaatggtaagttaggacttgaatcctaccctcaatagtaacaaaaatctttttttttttttttttttttgagacggagtctcgttctgtcacccaggctggagtgcagtgaggtgatcttggctcactgcaagctccgcctcctgggtttacgccattcttgagtagctgggactacaggcacccaccaccacacctggctaactttttgcatttttagtagagatggggtttcaccgtcttgatctcctgaccttgtgatccgcctgcctcagcctcccaaagtgctgggattacaagcatgagccaccatgcccggccaacaaaagtcttcttaatagtcccttctacttctctagactctggcaggtgtggggccctgtatatagaaaccgaggttggctcttgccctcaaggagcatattgtctaatgggaaggaaagacaaaagcaagtaatgatgatacaatgtgaaaacatgctctccaaggctaaaacaatgtgttttgggagctccaaggaggaaaggtctcaacccagcagcagagaaagcttcacagaagcagcaatataagagttgtgtactgaaggatgagtaagtttaccaaccagaaggccagccacagtggctcacgcctgtaatcccaacatcttgggaggccaaggcaggcagatcatttgaggtcaggagttcaagaccagcttggccaacatggtgaaaccccatatgtactaaaaatacaaaaattagccaagcatggtggcataggcatgtaatcccagctactcaggaggctgagataggagaatcacttgaaaccaggaggcagaggttgcagtgagctgagattgcaccactacactccaacctgggtgacagagtgagactccatctcaaaaataaataaacaagtaaataaaaataaaaagagttcatcagccagaaaagagggaaatgggcatccactattggggtagtcatgcaaacagaagcacagaggtaggaaagatcctcgcatgttgaaggtggtaaggtgggagatacgtaactgaactgtgagagaactagaaccgggctgaagagaaagaccaggggctgattgtgaaaatttttgtctgacgtgctatggagagtggggaagcttctgtagacaaatttcaggcaaaaagaggtgggtgaggcagctgctgcaccaggacggattaaagaagatgaggaataaaaacaatgggatgagctgaaggcacactcatggggtggggacatcctgggagacaaggacgtccaagtctgacatgaaacatgaagaaaagatgatgtctgttcaagagttccaatgaggcaaaacagcctactagagaaagcaattaaggatcctcaatatttaggattctgaagtgaaaacagaggaatccaaaaacatacataaagtaagaaaaagcgagagaaaatttcaaaagtgaaaatgatggagattagcacaagacctccagcagagatcaacagaacccaaaatataaatggtcaagactcaatattctatgttttaaggggagctgcactaagaggggtaagaaattgaaagcaaccaaaaaataaaaacaaacacactaagtctgttttagagataaggccattggaccatggaatacacccaaggacatcagaagggccatcaggcaccatcagtaagagcagatgatggcagccaagccaacttgagtagtagagatggttcatattactgcagggacaggggttaggcccacaaggtggttttctgcattttcccctgggagatgcatcgtaaatcatacacaggcatgggtgccagggtacaacccaggaaacactgagacctgcagtaacagcacaacttccttgtaatcttcactattgctcccatgatgctggctccaagtcatgactcatacttaggaatcaaatgttctcccagaaacactgttttaattacacatgccacttaaacagaaaggaaggccataccttcccattgatggaggcagaggcttaaagctcagccaatcctctgtctgaaggattcaggaaatttcccggtaagacaaggtagagaatgaacactatatctcctgctaaatgaaaggaaggacattggttgaccaaagccagagagacggaggaagggagggaggaagggaaagaaggctgatccacagatcaagctactaggaaatcaaggaggaattttaagtgttagagcttcaaggttcctcagagatcattttatccaacttcctgttttatagataaggaaaacgggccaaaataaggaaaacacctttagattcacataacacattggtaggagagagagggaagtggtggaacaagggtacatcacaccttcccattccaagatgctgcttttgccagggtctactatccaagtcctcagataaaccagccccttctttcaccagtggattcaaacccatgttggggaaggaaagagataaggagaagtaaatgggagataaagcagccacactctagttctggaatactccgaattattgattttggtggtggatggatggcccctttcagctgcactctcagcgcctgctcctgttttatgggtgtttccagtgtgcctcaaattatcttgcctcttatgaaaatacaggaacaattacatacaagcctattcagaagggacaattagctatttacatcagcaaagaaatgacagtgggctcttcctgacagatgccatcctcacactgtgttagagcagagagggaccttgttctggaaactgtccaatagctggaaggagacacctcctctgttattgtagtgtctttcttgcatttctgagcctgagctttctagacttctcaaaatgctatccagcaattggcagacccatcaattgaggatattggctcctcatcacctggtctcctttgggaggggtacacaggatagttgcaattggtttttaggacagccacatgcagaaacaaatggtagtcagactatgcagcagtataatgagcatcatttcctcatgatacttttatgatatagaaggaaataaagaagtgaatctgtggatggtaataaagtaaagaatagagaaacaatggatcaagatggaaaggaatgcaatgagaaatagattaaatgcataatcaaagcttaggaataaactcctgatgaatcaaaatgaccataatttaaaaacaaaaatagatctgctgaatttcaatttgaacaagccattcaccacataaaaaataaacatacagtatttcaatcttagaatttaagccctattttcaaatcaattaatcaaatactcatgcctgccaactctggcactagacatggtaggacataggagggaaagataaaataaaccagtatccttatccaaagtagctcgaaatccaatttgtacaaacaaggtgtacatgactgaattagtgaaaaggagaatttatacagtgagaagcagaagcaaatagggcagtgacacagcaacaccacatgtttcttctagtgaccagagtaactacctgagtgtcaattttctttgtattgaaaaaagggtgaatacagagtgacttgtgcttcactttaaatagaaaagtatttaatctatcaatgtaactttaaaagtcaaattgggcaaaactacaaattagtcttccatgctttagtctatatacctgtgctagagtgctctttccaaaacaaaaatctcatctcatactcttgttgaaagaaggaaagagggaagaagggagggagggagaaagggagggagggagggagagagggagggaggaagggaaaaagaaagggaaagggaaagggaaagggggaggggaagggaaggaagggaaggagggtaggaagggaaggaaagcaagggaatggagaataaaaaactttaatattccctcattgcttacaaaacaaaatccaaattctttagcatggtttataaaactcagtccagctccgtggcctagcctctgcctaaccaagttcattctcataatatgctgctaaatttaaaagtagactacagagcaacatgtacattcacactaagtgaataagcctgtcagagaaggggcaaatagtatatgcttccacttgtatgaaatacctggaacaggaaattcatagactcaaaaaagtaaattgaaagttactaggggctgggggattgggaaatggagagctattgctaagtggttagagagctcccgtatgcggtgataacaaagcttgaaaaatagtgtcgagctgtcaatagctgtacaacactgtgaatgtaattaataccattagattgcacacttaaaatggttaaaaattttatgtcaaatgttatgttacacatatataaacacaattttaaaaaattaataatgtaacataccaaaaaccattgaattgttcactttaaatgggtgaactgtattaactctatttaaataagctgttacaaatgtacaatatgtacatacaatactaatgtaggagaaaggcagaggaagattctcctaactgctaacagagattacctctggatggcaagatgcaggggatcctgttttctgagctttcctacatttcccaaatttttattagaactttgctttgtgctacttttgtatccataagagaagaataattgccatttttaaaatgttaaaactttaagcaagataaaaataagatataagccttaatcttctcccgttggggctcataacacatggtggtggaatgccagaagggaccctgggcactcagtactgcctgcattcttcttcgctgggtgagcctctggccacatgaatgtctgtgcttatgatgctggtggcccaaagagcttaatgatgcaaccagggactctgcaggaagactgctggagttccaccactcaccaagtacctctcatagcctatgtttcctcatcggaacaatgggataataatgttatttacttcataaggttatcaaaaaagtaaatgagataatttacatgaagtgtttaaaacaatgtctgatacccagtattctgacctaagtgtttcatcaatgattggcggctattatttttactgctgctgttgctctattacactgatgtgagtacagtcatgtgctgcataatgacattttaatcagtgactgtatataagacaatggtctcatcagattatagactgtatttttcctatatcttatctatattttgatatgttcagacacttaaatactaatcactacgttacaattgcctacagtattcagtacagtaacctgctatacaggtttgtagcctaggagcaataggttatctcatatagcctaggtgtgtagaaggctctaccaactaggtttgtgtaagtacactcgacaacgtttgcacaatgacaaaatcagctaacaacacgtttctcagaatatatccagtcattaagtgatgcatggctgcatttgttatctatcctctaccagagcagggattggcaaaccatggccaaagggccaaatccaacccatcacctgttttgtatggtccacaagctaagaatgtttttaaatttttaaatgcttggaaaaaacacaatagtatgttatttcatgacacacagaaattatataaaattcaaattccagtgttaataataaagtttaattggaacacagacactcctatttatttatgtattacctatgtctgctttcatgcacttgggacaaagcctgtctagcctgcaaagcctaaaatgttcattatccgccccttgacagaacttacttgctggggaataaattctgaaagtaaagaccagctcttgttcatttagagttaattcatggttagattagattggagttcatatttactgagagactaaatatacaaatggacatggccagaccatgtataacagaactctgacctacaacctctgcagcaaccagcctgggaagccaggccacaacctctgcagcaatctgcccagaatgatcagggtttagtcagtgactgccagcttccttactttttgtcccttcctccaaccaaatattctccccaaaccaatcatgtaagatactctgcttctagttagcccgcctccagcttcctcatgccagcaacctctgatcacagcacatgtatccgaaaccttctctttttcactgtaagaagtccaaaaagctttcccattccactgcctgcctttgagtctctgccaaacactaaggatggcagcagcctctcttgcaatagcaaactctgaataaatagcatctgtttggtctcctttgggtggtctttgtttatttccagttaacccggacaccccccaaagatacaatctacactgcctatcaccatggactctagtcttaaccaggagtggcacccatgaggccccttgtgccttgctgtttgcaggctctcacaggctgtcaggtctgtgacaacgtggtaagttagcactgtgtctgattccattctctgggcattgagttctttggctgtttattttcctcttggtaataccaggttttgttattggctcccatttgtttggaggaatcaagccattccttttcatccatgtttgctcccttttgtccttctattttgcattgtgctgtctccgtgttgtttgccatgaagacaatcacagggtagaacacaggcacaggccctataagcctgttgtctaagccggctttacagactgataattctgtggttctcaccagatcagcatccacttggacaaacgtttctgtgactcaccaataaaactggataggattctccttccatctctattttctgtcctgagagcttggctctaatccagagagaacattctctggttttcttgttgggagggcgcagattgccaggtcagcatttgaaggcatccacttgtgaggtgggggctctgagacactaagcaaacaagcatcactttcaccaactgctgggacctctcatgggattatatgtaagtctaattcttctccagaaaaaaactcttgcttcttatatgtactgtcactacaatcctaattattgtgcctatcatacctcatttcatcaatgtcatcttcagtggatactctaagcaacatgagccttaaacaaaactgcttatttgaaaggggcttaggggaaaaagggaataagattgctcaggcccaatgggcagcatttttttttttttattagcatgcagaagcctccaaacagcattctgattcaaaatggttcacaaaagattatttgaacaatcttaaataacacaaactagattcatttccctagtaaattctcccccgccttgtcttttagttgcctctctatacccagtgccctcttcccccttatcctgatctatctccttctgcacctctctcaactcttctctttgtcaaaactcccttccttttcccaacaactctcctaaggccccaagatgccacttgcatttaaagatccatcccacccatgggccaggcattcagaccactgtggaatttaaaccttggtcttgagctgaatgaagagctagcaactatttatagaagaatcctagacaagaccagccactatttatagaagaatctataattcttttgagtgcatttgactcagggttaccaaactttatcaagctgcaaacattgattggaatctaaatcctgaatagcaaaagctaattggactatcccagaaaaagatctatggaatttctcttttcacaattaaaaaaaatcaagagctgagatgggaggactgtttgagcccaggagttaaaaacaaaaacaaaaacaaaaaaagaggttgaggtaggagtattgcttgagcccaggagagactccatctctctttaaaaaaaaaaaaaaaaaaaaagtgtaaaaggtaggacaaatttttctaaaagtcatacccaaaacatttccaataaaagtagacttgaccaaaaactatctactgggtactatgctcagtacctgggtgacgggatcaatcatactccaaacctgtgtatcactcaatatacccatgtaacaaacctgcacatgtaccccttgaatctacaataaaagttgaaattattcttttttttttaaaaaaaaaaaaaaagcaaatgtagaccagctaagatcggtcatacatcatgggatattaattatcaatttctattgggtaaaagttcaggaatattcactcagactatttgccacctcttttcatggtttttcagagatcattggtagctcttaattgggaaaacatttagccccatttattggaaggatataaaataaagccaccccagatgttttttaaaatagacttgaccataatacagtcataccaacagacaaaagattaaactgtaggagatttcaggctagacgagaagataaccttcaacaacatgcaagagttaaaggtgctgatctaacagcagctctttcatcttggccaaaagtactaccattagtccttatggccatgcaatccactccctcaaggacacattggctatcctcctatgaatgggtaattggaaggcccatgtgttcagggatttcatctcgaattctagtagttctgtcctgctgcacacagatgtggcaaaatattacaacggaatcatgtactatgcccagcttgtcaaaaacaggttaaggcccccttcccacaacatcgtcctaaatagcatctttataatcttcttgtctattgagaaaaaaaaaatcagaaaaaaaaaacctgtttttgaatcttgttggaagagaccttatccggtactgttagcaataaatatagcagtgaaattctaaggagtcaattcctgggttcacaactacagaagcaatgcagaattccacagaactggaaggctactccataataggacctcaagggaggattctcagagatcctctagaagtcgccagctttcagaagcacacagctgatgacctcacataggggacagcttctacccaaggcagcgggccaagaaccctgtctaattctggttttgtttttcatccacctccacgtgatcattcttctcatcttctgtagagtcctagttgttgtccactcataatggaactttttctctgttctttcctcttctttataatttttggttcagaaaatactcattcttagattatcccaaacagtacccactcctttgatcttactgatttctgaacacactgtctatcactggatccccatgataaaatcctccaggcaattccagtctcatgcaataagaccataggaaaatacagtcaatggcatctccatttacacctataggaacaaatgaccttaaacaaatcaacctatgactttgctactctccctctctgccacaaaaaaggactaattattacaatctattattcagactctagtcccacatttgaattcaacacatttcctacagtgatagtacagatacttgctacctagaggagactcttagagattcgaagatgtaacccagctaaccagatgctccggttgtaactttgtgtcataaataaataaatctttttgtcctgtatctccatgagcacctactggatactactttttttttttttttgagacggagtctcgctcttttgccaggctggagtgcagtggcacaatctcagctcactgcaacctctgcctcccggattcaagcaattctcctgcctcagcctcctgagtatctgggactacaggtgcacgccatcacgcccggctaatttttgtatttttagtagagacggggtttcaccattttggccaggatggtctcgatctcttgacctcatgatccacctgccttggcctcccaaagagctgggattataggcatgagccaccacgcccggcctggatactacttcttttatggccaagaagcctaatcccgcttgcctcagactaatacctcatgcactttaggaatcatattccaagacttgtccaggcacagggactgtaagtctataaattgctaaggctgtatgtcaactccaaaataaggccacccttgattattcaggcactccacctggggaaattaatgactcattctttatgcaaacaatcagagcagtgttcccaatgatggaaatcttagaaacatcaggaagaaacctattgctaactctggcaaaagttattaataatactacctctgccctggatggaatacagatcattcccaattcattggcacagatagtgatggacaattgcattgctccggatttcttgttggctggtcgtggtggcatgtgtgtcattgctaatactgccttttggactgggatcaaggaagtaggaaagacagaacagactaaacactgcctgaaggaaacagttacttggctttctaaggttgatcctcatggcctatgggatttgttctcttggccttggttaaacaatttgtgttcctgatttgtttgtttgtttgtttgttttttgggttttggtgggggtttttttgtttttttttttttttttgagacagagtcttgctttgtcacccaggctgtagtgcagtggcgtgatcttggctcactgcaacctccgcctcccaggttcaagcaattctcctgccttagcctcctgagtagctgggattacaggcatgcaccaccacacccagctaatttttgtatgtttagtagagaaggggtttcaccatgttggcaggctggtctcaaactcctgacgtcaggtgatctgcctgccttggcctcccaaagtgttgggattgcaggcatgaggcactgcgcccagccttgcttccctggttctaaagcagcttacagagactattaattgttctcatttttgccacagtggtcataatgttacttattgtgttctatatggagccttaaatgcttctgcacaaccagtctcttatcaaatgactgccatgattgaaatatagtttactacggagacatctggataatttctgagaagtgaagattcagattctggcttttccagaattggtcagccactcacaagccagagaacgaagaaaagaaaggactgaaagaccaaataggcaaaagaacatagccagactatacaagacaatagaacactgtctcaaaacctctgcagcaaccagcagcaagagccaggatttagtcaatgactgccagtttctctattctgtgcccctacttccaactcagggcctagaaaaggaagccaaatactgcacttttaattagcccatctgcagcttccccaagccagcaacctccaatcaaaaggatatatatacctgaaggctcccctttttggattgtaaagctttctcactctaccacctgcctgtgtcaaacacgacaagtaatgtaagcttcctctcttgttatggcaagctctgaatcaataacctctgttctcatttgggtaatcttcatgtatttccacactacacccaaccacatgcatgcacacacagttaaaaatggcagggccttgtgcaagatactagaaatcccagcagccatataaagagggccacttttcagtgaggcagtacattctcacctctctaccccacctcccaagggctcaggttcagctgctaccacctattaatatcccctcccttggctagcctgtcatcccaccactgtacccaggctttgctcagacctatgtcagggcatagccacaaatgggttaccagtatgactcccatgccatcaccctcagcaagcatctctagccaggctcatcctcatatgctcaccccagactgacatacaaatattaccatcttctgtatacgctattgtttgagaagcctaggaaagcactaaggagcctctgtgccacccagccctgggatctctcatgctgtgttttagcctctgccctgggaaggaatttgtatgagtctatagggcttcaacaaaatgcccaaatgagaggcatatgttgcttgatgggaaagagagttgccccacaagaaaatgagctaaagagtctgtggttagaaggtatttcatgctttcaaattctgagaactgtacaagctgcaatgtgagtccaaacagggagagcccttatattctcacattcccactgatggtaaattatattgattaacattagcaacattaaatcatattgctaaggctaattattataacaatacatcacctaacattaaatgaactctcactatattccaggcacaatttctaaatacttcacatttttttaatcacttaatcctcacaacagcctgagaatgcagacactattaatgaacgctttgtaaagattaggaaactgaagctaagaaaattataacaaggtggccaggtgtggtggctcacacctataattccaacactttgggaggctgaggcaggcagatcgcttgagcccaggagtacaagaccagcttgggcaacatggcaaaaccccatctctacaaaaactacaaaataagccaggtgtggtatcgcgtgcctgttgtcccccgctactcaggaggctgaggtgggaggatcacttgaatccaggaggtggaggttgcagtaagctgagatcacaccactgcacaccagcctgggtgacagagagacactctgccttgaaaaaaaagaaagaaaagaaaagaaaattagagcaaggtcatacagcagaacaggagctagaactgagctctaatctgttagacttcatactctgagctataaccgctaattcacaatgctacttaaaacccatatttgactgaccacctaactaagcaactcaggcaggatggcgtaatatgaataataacaaatacatacaagaaagaagaaatgtatcattattcagcaactaaaaagtaaattctaatttatatcaagtcagctgttaatactgtatcaattctaattagatacttgtgttgtactttgacaaatacagaatgtaaattcttttagtgcttcaatttactgtggcttttgaattaactttgcatcagcaattgtcttccaaattatttgagataaccactaatttcatataagtctattttacacaccaagacagcattttatcagcatttttcagtctcatattaatgagaatttaactaatatatgtaaatcacaatgatcctataaaatcacatgaaagccaggccgatattcaccaaaaaaatctagaaatcacactaccatttgtgtgttatttcagaagaagtaggttcagtaacttgctacttttatacatagtcaatttctataagctaaaaagaaggaggaatttgaaagtcagttgtctattcaatcttaggatgtgttacttcctaaatttgaatacaggatatgaacaacctgggacatcactgtatcacaaaagcatacttaaggctcaacaggggattagttggagagcttcttggctttcccatctcaccatcctcacccctcccaatttcatgctggaaacagacagcagcacattggtgtaaagcaagagtcagcaaatttttctgcaaagggccaaacagtaaatattttagtctttgctagccaagaccgtctctgttgtaactactcaactctgccattgtagcacaaaagcagccagagacaataaaatgaatgagtatgactactgtatgaactttaattattttttatttcctaaatgttatgtattcatgtgtttattttataaattttatttatggacatggacatgcgtatttcatgtaattcttgtgtgctctgaaatgcattcttttgtgggtttttttaaaccccatttaaaaaagtcaaattcattcttgctcgtgggctatacaaaaacaaaaggtgggactaacttggacctttgatcctcgttggctgactgctggtctaaagaggagttgtcccagttttcctttataatatcatcttcaatcaagttcacaccttgcatgcccacccctatgcacagaggccatccagtgtttttgtttgtttgtttgtttgtttttgagactgagtctcgctctgtcgccgaggctggagtgcagaggcgagatctcagctcactgtaacctccaccttccaggttcacgccattctcctgcctcagcctcctgaatagctgggactacaggcgcctgccaccacgcccagctaatttttttgtatttttagtagagacggggtttcagcgtgttagccaggatggtctcgatctcctgacctcgtgatctgcccacctcagcctcccaaagtgctgtaattacaggcaagagccacagcgcctggcccagtgtttgtttttaaacaataaatatagccaacactttttacatatgtattacttattacacttagtacttgtgatgtacttactctatgccaggctatgtgtgaaatgctttgagtataccatttaatttattcctcccctagaccttaaagatgggttccatcattatctccatttacagatgagaaaactgagcctaagagaggttaagtaacttcctgaaggtcatgaaaccagtaagtggtagggctaagaagtttgactccacagcccctgttatcagtacccactattatgtcatcctcaaagcgcttctgtgggacagaaggcaggaaagaagagtaaaaatcaaccaggatgcttgttatttgaagaatagccagcaggagacatcaacagagcaaaggctacaaccaccaacacaatacagaaagctcatatttttacatttcttttgaaaaatgactaatcctgattatctcagtcttttatttaatggtgaatactgccagtttcaatgcaataatatttcaattcaataataaactactaagcatgagggactaaaatctaactgaacatctattcagtgtcttcctagtttatacttctttgagatggatgagagcagccatccctgtattcttcctcagtgcttgcatcaagggaggggacccaggatgctcccaaaattaccaggttgcatttgtccaccacaagggagaatttacatagtaatctctccccaaaatccttccctctaggaaaaagtctccaaacttctcttcctagaatcaggaggccagaatcctggagccagggctaagcatgggagagcgggaaagggatgaagatgccaagggaaattagatacagtgaaccctagcccaaaggggctcccaaaacatcagttctgaataggtgggaagagagtcaagaaccaaatctaaagtcaagggtccccagtttgggtcaggcaaacagggtaggcccagtaggaggaagacactggtggctagagaagagagaatttttgttgaggttgagcctattgcctcattcattccttcaacaaatttgtacgaatatcactttgtgccacaactctaggccttggggatacagcagtcaacaagacaggcatggttcctgccctcattgggtttataggctgttgatggaaggcaatccaatagtaataataaaggtagaggaacatacaacgatgaaacactaaatcttatagaaatactagagggagagaatcattaagggtgctgtgttaggcagcttcgtaaattgttcctaatactctccacctcctggtatgcatgctcttgtgtaattccctctacttgattgtggcctcgatctagcaacttgcatccattgaacagaaagtaggaagttattaaaaaccatgatttctgccagcttacatcctctctttcttgctctctcttgctcaatcactctgagggaagtcagctgttgcactgtaaactgccctatggagaggctgaagtggcaaggaactaaggaagacctccaggtaacagcccatgagaaactgatgccctcagtccaatagcccacaaggaactgaatccttccaacaaccgcatggatgagcttagaagcagattcttccccagtcaagctttcagatgagactgcagccccaggtggcacattgattgcaacttgtgtgaaaccctgagctagaggatgcagctaagctgtcctcagattgctggcccacagaaactgtgagataataaatattgttgtttaaagtcagtaagttttgaggggatttgttataaagcaataaactaatacagattccaatccaggttgcccagaaaatatctaccaaactctctcagacttaccctgtttctcacaagagaaacagattatagagcatttactaacaaggcccagaatctctgataacattggtaacattgagattgatgttgcaaatggaaaccatccctctcaatgggtgaggctgagctggctccagctgtgagacaaagaatcttaattgctcccaaaaaaaaaaaaagaggtgagttggccgggcacagtggctcatgcctgtaatcctagcactttgggaggccgaggtgggcagatcagaaagtcaagagtttgagaccagcctgaccaacatggtgaaaccctgtttctactaaaaatacaaaaattagccaggcatggtagcacaaacctgtaatcccagctactcaggaggctgaggcaggagaaccgcttgaatccgggaggcggaggttgcagtgagccaagattgcaccactgcactccagcctggacaacagagcaagactctgtctcaaaaaaaaaaaaaaatgaggtgaaagaagaaagtccctcttttggcaatgagctaagagtggggcagattaagaggagtctagtagaaccagaacagagaaaagtacagtaattaaagaagtcgcaatacatgggaggctatttctaaaatatcatttgggaggcaacagatgaactgacttacccagattcggtttttcaagggtaagaagcacatgtaattataatggtccttcagtgctcccacagtatcctgatgcacctccccccatcacgatcccttaacatgcttaactcaatgaactgtttactgtcctgtttctccgattagaggcccaatgttaatatcaattaccactgtatcctagtgtctagtacagtgcctgccacacagtaagaattcagtatatacttgtcaagtgagtaaaatataccagttttgtgacaaaaaatatgcataggaaaaagaccagaaaggaacacatgaaaacataaacaatcttctactagatggaagagtatgatccttttccttgatatacgtgtctccattttgtctgcacatagacttgtctgtgcaatgtctataatgcagagaaagaaatgcctgaggatgccataagacagatcttttgggtcctacagagtttactttcataattttataatattaagattgttgccataaatttccaaactcaaagacatttatagtagattatcatctcacttgtcaatttgtcaacctgaaaactgagttcttaagcaccatgtagaaactttcaaatataagttaagatatcaacacctgcagagcaatattatgcataaagatgtaaaattaatcatttcacacattaggccccccaaaaaagataacaaatgggagatcatatcgtattaaaaataaccatgtgagattctttggattgtgcggtagcacagctctcaccaaacttcaaaatactctggaattcgggtgcagtgattcatacctatactctcagctactcgggaagctgtggcaggagaaccacttgagcccagtagttccaattcagcctaggcaacatagagaaaccctatctccaaaaaaaaaaacaaaaaacaaaaacaaaacaaaaaaagtatcggagcatccaacctagcaagcaatattgccccaaaatgcaatcaattaagtggaagattttgcatgcatgtatgtgaatttcacatttttatcctgagtcaccagatcacaaaaccagcaagctcaatcttcttgaagggagcagatcgcccgcccagaagctcaataccttccatttgggaacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactattgcaagaataaaaaaccaaacactgcatattctcactcataggtgggaattgaacaatgagatcacatggacacaggaaggggaatatcacactctggggactgttgtggggtggggggaggggggagggatatcatcgggagatatacctaatgctacatgacgagttggtgggtgcagcgcaccagcatggcacatgtatacatatgtaactaacctgcacaatgtgcacatgtaccctaaaacttaaagtataataaaaaaaaaaaaaaacaaaggcagcaatctgaaactggttctcaagattgtgctctagatttatacagatagaaaacattttttccatataattccaagttcccaaaagagcccaaaatcattcatatgtcccaagtttagaatgtcaccaaataagccagatgaattgagttcagagacaggctcccattcctgccttgtcatgactataccagcagtgtgccagaaacagttaagggacacctccactgcaacagaggcactgtgatttggcagatgtacctccattcgagaaccctggcctcttaagttagccctgcacagtccaatggaagtgtaatgcaagccacatgtgcaattttatattttctagtagccacattttaaaaatataaaaacaaataggtgaaatccatttcaataacgtattttatttaacccaatataccaaaaacagtgttttcgcaacatgtaatgaatattaaaaatcactgatactttacattcttttttgttgtattaaatcttttaaatcccatgtgtatgtcatacttaaagcggtcaattcagatagcccacagttcaaatactcaatagctacaggtggctactgagtattgagtataccatattggctattaagtataccatactggacagttcagggtaaatgcacttatcctatctgactactcaggagagaccttcttgtgttattacttatgaagatagctcatctctcatgaatttaagtcaaagccaaccatatagagatgaaaaaaaaccaaaataacctggtgtagcttctattcactggtgaaataatatatactgaacaccttctctgtgccaggcactgagccaagggctttacatagctcactccatttaatgctcacagcaaccctaagagaaggtacaactgtaatccccatttacttatgatgaaactgaggcatagaaagttaatttccctaaggtcacacttcaagcaggtggtgatgcttggatttcaactcgagcagtctgactctacactgcacactctacccactgcacatactcaacaagagggagtaaaagaaggatatgaaatgcacggttaagaaatcttagtctgacatgagtgtgcatatcagaaaagaatcaagaaagtatttgaaagcctgcgacagaaatctaggcttgagatacagagataaattcacctacaaggtaaggaagggaagggaatgaaatatgttcaacaggaaaaatagaattaagaactaactaaaattttgtgtcaacaactgatgacgacaatgatgatgatgataagaactaacatatttggagcctttgctctgggtcacgcattgttctaaagtcagtttctcagcctcagcattatgaacgttagggctgagtaatgattgtaggagctgtcctgtgcattgcaggatgttgaacagcaccccgggccccctcactaaatataaggaacagcactctactctcaattagcaaacaatcaaaaatgtctctggccattgtcaaatattcccctgggaagcaaaattgccccctgttgaaaaccctcaatctgagtgtttcatatacattatctcacttattcttgacagcagacgtctggggagacatgattgctttatagatcagaaaactgaaggtgtggttgggcagctgacctgaggtcctgtcgctaataagtgaaagagctagacaaatccaaatttgtctgattctaaagtatatttttactgctagcccccagtacaagttctcgtctcatctccaattcatacagggatttgtgtgctttcccactccctgggctgatgctagagatgaacagaaacaaaacactgctggacactcctcaccgagaagttctcctgccacaatcaccttttgtgtctcctttccaccttgtgtctcttcgctctatttggacccacgttttcttggctaatagcctttcaggaaataggcatggtatgaatgaacagataaatctttaaagcctgaatacatacttatggagaacgagtcctcaaactcaatacaaacatccaaccaactgcaattaaaagccacaaatatgtttttataagaaaattaagctatcaccatatcatctttgatataaagtgagatatgactaaaaatggaggtaaagttcaaattgctacaagttgtaaatttgttcttgaaatatcaaacacatgggaaacagaagctaattattttgtcctatttttgtatgtgaaaattacttataatctgcctgttaaacaattcaaaattattttaaatgataattgaccatcaaactaggccaatttacacctacaatccctctgaaattgcctagaaactgggacaactgcagaagaaaagaaaaacacttccatttgcgtcaatgtctttgtttttcatccatcagtctccaaggctgcaaaatcagaaaagcttaagcacaactgattaataaggaagcactttaggactttgcattatttgattatgccaagaaaaaccttataattctcataaattcattattccgatattggtcatgaggaagtctactttttaaagaaaaaaatggggaatttcttcttataacttcattgtcaatatttttaaagtattatatgatttgtttaatgcctttaagcccatcccaatgaaggaaaagggcatttgttttcgtattacaatcattcctgggtatacttaggggattggttccaagaccccctatgcataacaaaattcacgcacactcaggtcctgcagtgagctgtatagaatctgcacgtacaaaaagttaaccctccgtattggcaggttttgcatcctgtgaatactgtattctcaatctgcattcagctgaaaaaaaaatccacgtgtaagtggatcctcacagttcaaacccatgtagttcaagggtcagttgtaatttacttttaaaaaaaaatatgttagccagttgcagagaatagattcaatagcagattcttcttagtgtctcaaagatcaacttaaggagaaagaccaaaaggagggaaagcaaagcagagagggaggggaacagaaacaaagagacaaagaaggaaggaaggaaagagagagaaaggaaaagaaaaaaaatagaaaaaaagtaaggtggaaaaagaaaaaaaggggggggtggaaaaaaaccaggcaaagtgatctctgatggctcatgagagactctgatctccctatagctctgtatatcccagaatctgaaattctcaaaatcccttcactgtgcattctggaactcagggtcctcaagaacaaagatctcctataccctcaacctcttcgaaaatgatagcttccctttcctgacttaatccattcacctttccacccttgttggcaagtacttcataccttctccttcaaagcttcagcacctctttccccatactcacttttaactattggccttccttcccttttcacccagaaatggaaaccacagaagagaatttcctttacctgcagcaccccatcaactcacggacttgcatctctgcccagatcctctgccatccctcctgtaactctgggtgccccaacacgtgtgcctacccatagtagcccctcctcttgtgtactagatcccatcccacccccctgctcatggataccactgcagcagtgcattttctaccaggtcagatcctatcagcagacaaatatatcatcatgtctctcatctcaaaaaggccttctcttgacctctacttctttctccacctaccatcctatttctctccattctttatagcaaaacttttagaaaaaggtgtccaggtttatggcctccaatcagaatcaaactttccccccaccatttccccaaaatagctcttagcaatattgatgtcattagtgacctgaataaatccaatggtcaattttcagttttcatatttcctgatctatctaaagtatttgaaacaaatgatcatgccctcccttgttgaaacacttttcttcatttgaccttaaggataccacactctcttgtttcattccaactcatctactcaacctcttaatgttgcaatatcgcagtgttcattctctggccacctttttttctctatatatgattatattctatattatactcacctttttcatgactggatgcaatctttctgctaatcagtcccaaatttataccgttaggcttgctatctcatccctggactcgaaactgcaaagccaactaattaatcatcttcacttggatgtctaatagataccccaaggttcagatgcccaaaaccaaatccctgggtttaccctccaaatctgcttccttgtactttcccatcagtaaatgacaactgcatcctaccagttgcccaggccccacaccttaaaatcattcttaattatgttttttttcccatcccacaatcaatccatcagtaaatctacccagctttatcatcaaatactgccataatctgaccacttctcaccacctgcactgctcctatcctggtgcaagtcaccaacctccttcacctgtactgagcatttgtctccagtcttcctgcttctaccattaccttcccatgcttattctcaacacaacagccagaggaatcctgttaaaacatcccatcgcccttctattcaaaaaaccccccactggaatttcacaaagagcaaaacccaggtcgctaaaatggacaacaaatccttccatgatccggtgcctttccttctaatcctgtttcagacttctgatactactaatcaccatctcacatcccacatactacactttgttgctgtcactgctataattattgtctgtatgctccactagcatataagctccaggatgagagaatttttgtttgtttcattcatttatatattcccaacatctatcacagtgcctggcacatagtggatactcaacaaaatgtgctgaatgaatgaatgaatggaactctgagagtcagaaaagcatcaaatcacatctaagaactagggatttaatctcatccctgtcattatggccttactctttttttaattgtgataagatacacataacctgaaatttaccattttaaccatctcaagtgtacagttcagtggcatcaagtacattcgcattatgacacaatcatcaccaccatccatctccagaacatttttcatcttcccaaactgaagctccacacccattgaacattgaacaatatctccccattcctttctccctccagcccctggcaaccaccattctgctttgtgtctctatgaatttgactactctaggtgtcacatttaagtgcaatcaagcaatatttgccttcttgtgactggtttatttcatttagcataatgtcctcaaggttcatccatgtcatagtatgtgtcagagtttcctttttataagactttatatatataaacacacaatagaatattattttatttatccattcatccactgagggacatatatttggattgcttctatcttttggccatggtgaataatgctgctatgaacatgggtgtacaaatatctgtttgagtccctgcattaaattattttgggtatatatccagaagtggaattgctggatcatatagtaattccatttctaatttcttgaggaactgccatactgttttctgtagcagctgaatcattttctattccctccatcaatgcacaaaagtttccatttctctatttactcaccaacacttgctattttgttttttgtaatagccatcttaatgggtataaagtagtatcttactatggttttgattcgcatttttctaatgactagtatgttcagtattttttcatatgcttgttggccatctgtatgtcttctttgtagaaatatctattcaagtccttttgcccatttttccatcaggttgtttggttttctttgatgttgtcaagttatagaagttctttaattattctagatattaatcccttaacagatatatgatttgcaaatattttctcccattctgtggactgctttttcaccttgatagtgtttttgatgtatgattttaaattttgatgtagttcaatttaactattttttcttttgtcacctgtgcttttggtgtcctacctaagatatcacttccaaatctaatgtcataaattttcttgtaaatgttttatggtttcaactcttgtgtttaggactttgatctattttaattttcatatatgatataaggtaagggtccaacctcattattttacatgtcccagtatccagtttttccaacaacagttgttgaaatgatggtcctttccctaatgaatggtcttagcacctctgtcaaaaattactggatcatatatgtgacagtttatttctgggcccttgtttctttgagtaagtcttctaagctctccaacctccattcccaaaaatgtgaaatgaatagattccaccagtaaggatgtatcttattttgtcttggttactgtaacaaaataccataaactaggtagattattagcaatagaaaatttatttcttatagttctggaagctgggaagtccaagatcaaggtgccagcagatttgatgtctgctgaggggttaccttttggttcatacatggtgacttcttactgtgtcctcatattgtagaagaggccaagcagcaatctggtgcctcttctataggggcactaattccattcatgagggctctgctgtcataatccaatcacttcccaaaggccccatctcctgacaccaccacattggtggtgagtggatggaaaatacagccaaagtcctttctccaccaccctaagtatggccagcattaatgatttccccaaccaacacatggacaccatacaccatataccagatttgagcaactagtgggtgaaaacggaacatgatatgtgtttcttaaatgccttaatgttctagtagcacaatcatttatgtaatattgaaatctctacataaaaatatccacatggccatttgatctatgttaaggcacctcctccactaatggggaactcactaattttagaggaaactaattccatttatttaaaactttggctattaagacaatccataaacatacatattctttttaaatggtttgctttcttcagctatgttattagctcatttgggtccctttaagaagactctctaaagacaccaaggctggagaactaccatgaatgggacagctataaaatgagtaagaacagtatttgcagctaaatggcctgaattgcagagtagagtatgagatgtaatttggttcttagggcatccactgtaaacttggatctttgccaaaaggaaagcattatgaactactgatagacatatggcttcaaagtcatctcagttttgaacaagtaaagacagaatggaaagggttggttcagtatgaataaaacagatgaccccaaattacctctcaagagtaaattcagctctataaaaattagagatccagtggcaaggattaggaaaacacttaagcaaagctttgtacctacactgcaaagccacagatcacttggtaggacaaagtcaagaaagactcaaaactcagtgacagcaaaaaacaagatgtcaacttcagtgtattctacattaaaataaatattaacagtaataattaagtcacagtgaaacactccaagcatcccagatttctttgactttcgttcctatgatggttatggagatcagttctgattacacttttcttttagtttattttgatggaaagaactggatcatggaattatccccaaagcttcccaacctgggcgatcctccaaaccctctggagaacttttgaaaatatgggctccacactagacactctaaatcagtatctctgcagttggattttgttgtcttatggggttgtttttgtttttcttttgtatttttgtttctgttttttaaaatttccccaagtcattctgattataagcagggcttgggacctgctggtccagaccccatacctctactggttttcctcgctggaaagaccttagtaattggctctgcaaatgaagagagcaccagtgacattgggagacactactgctactgaaaatgataaactgctaggtcacatagaaacatggagaactgtatccaatataatgctaattatacagcaaatgccagatataacaccatatgtaagacttttgggcaggtaaaataataggtacagcagaaactctttcattccatatgaacagcatataaaagtggttgcaacagggcctgaagccttttgttggcaacaaggagttgcctagaactacctgtgagagggacctgcgtggttttcacctgggtggtgccattactttcaatggcaaaaactgtgattattttggcaccaacctaatattttaaaatgtgctatagtgaaatagcatctatgtgaagtgcactaatctataagaatttaatatgtgtattaaactatgttcaaattttggctatataataaataaatataggcattagagaatgtcacatcaactttaaaaacacaaaaatgctatgagctgaaattatttataattactatgaaagtgtttaaccaatttgttattattgttatagagccccaaaacctctgttacaaaattcatcagtttggtctctgtctaattctgcataatcctcaaggattctcatcacattgtgggtgttcttggcttctctttaacctgtacaatgcaaagtgatttttttaattttctaaaatgaacacactaataaaatgggcagtggaccatactaaatattaactccctgctgtttgttctctcttgtttatttgactattcagattctctgccatttgtgtctataaaacccgggattaggtcaggcagatgcaggacaatattcgttcaccatgacaacactgtcgcctttgctaatgcatccaagcccttggactgccttcgaaaatgacaaggagattttataacctctctagttgagctcttctcaccacctgaacagagacaagggtaatcaaattccatttcaaagaagaatatcattgcccttctttcacctctttcttttccaagagtgtccttgcaagatgcgtatgacccagccatcaatgctaaagagacatgattggataaggagacagagcaagtccccctttaccatctctaactctcattttcaacaatgactccctgcctgtgactagaataatgtggtgtgttagggaaagttaaaattaacagataaatatcttcttattacacatttgtagagagagataattctcaaagataattcctgttttcatcttccattctatttctccccatgatcattccattccctttaagacctttccaatatcatatttacatatacaaatcctaactcatcattttcataataaatatttatgcagcaccaacatgggctaaggactatgttcagcactgagcatacaatggtgatacagtttggatgtttgacccctccaaagctcacatcaaaatgtattcctcagtgttggacgtaggccctggtgggaggtgcttggatcatggggacagatccctcatgaatgtcttggtgccattctccgggtaatgaatgagttctcactctgtgagttcgtgctagatctggttgtttaaaataacctggaacttcctcctctcccccttcctcctgctcttgctatgtgacatgctggctccccttcactttcagccatggttgcaagcttcctgaggccctcaccagaagcagatgccagcatcacacttcttgtacaacccgtggaacaatgagccaaaataaatgtattttctttataaattacccagtctcaggtgtttctttacagcaatgcagactaacacaaatggcatccaagagagtccacagaccttgccctcatgaggcttgaagtctagacttccaatggttacttcaaattacacctcttctcagaggccttccatgattcctttccttactctacgttgtcacaatactctacccacactgtacttttggtctgtatcattttctactttgtacggcaatcacatatatatctaatctcctctgtcgatccacaaaaagtgtaggccctcattcatttttgaaccctaacagcaactcagcattcaataccttgcttataggtggcacgccccaaaaaattatcaactcaataaaacacacaagggagcaggaatgtatcaacctttaaaatcaacattaattatattttcaattctaaagagaaattacagacagaaagagaaatttatgaaaattatggagcaaagcattcagagtattaggagtaccaaaaaaaaagagtacaaaaattgtaatgcatattttatagaactcttcctgaaatgatgaacaaagaatagctcactttcccatctaaatacattgtagataaatgggaaaaagcaaaaaatataagccagttaagcaatagctgttaggttgaaagtattgatcattgggggactctattgcatgggaggagggaaatatatcaaggagtttaattaacaaatgctggagaaatcgtgctagtcaaccagaccttgaggcatgagtcagacttcacagagaaatagtgtaaaatgcagagaaaagccagactcactatggaatgatctgcagtcttttaaccacaagagtcagtgtcacagaaagaacatgacaaagcagtgcctacgatttccagagttacatgcgaaatactgtttccctgccagggaaaccccagctcatgacagtggcatgagaatgagaaaggccacctgcaaatgaaatgagaccatcccacctgcaacagcaggagagggccacacatggtcttgttagtgccatttcaggagttgtgctgcagaaccagggaggagaccagacattaggtcaagcctgtgatctcaagggagctggcctgctgcttccccagaggacttcagctagagtcagtggagttaataaatcatgtaactgtctggtcccattatctcaacccatctaccctttgattctgctgcttggaaggaattcccagaaatcaagaaacccaggctgagaacccatagatgtcattctctgagtaaacagatgttcaaaccttgaagaacccggcaggaatctgccctgcctttaactaggaagggtaggcccatctagatggagtccaagaacaggcaacagctatataaatctaacttcacaaaggttgctaaattttggtagttaaatctacagctgactgtgaaagggagccttaaatagggctgaaattttaacaatgaaaaatcatttagttaataattcctttttccattctaaaccagtgacggccaacaaaataaatgaccatgttgaactcaggaatggaataatatgttcttacaatgaaaaaaaaatccttttctgaaaacctctctcaacagcacaaaatgccctattagaaaccattctttaattagcttttccatcagcttttccatccactatattttacactgcataaaatacccatcactcaacttcttagaaatccccccactgagtttcaatggaaaaaattacaaccaactcaacactgggtttccaataatgctcttatttctataccaaaaatagaatttcacgactttcttctcctagcttgcttttcaaactaaactaacactaggtcattctcccctgccccttacctaaatggttgagtgatgagaatgttataagcgatctaacagtgaaaagcaaaaaagggcggcaaaggagagtgattggctaccttgtacactgggtttaggaggattctaaagccaaaactaggtttagaggggaagtctcacgattagtgatgtctgccatcagaaccaaaatggagaatggcagtacaatatttgtcattggggctatctataaatacaatagctggatatacagaaaataattgaggtgcattttcagtagcaagaagattcttaagttatctttggttttgtttttaagagttagctggttcatatgcaacataaacaagagttcactacctggcctaatgaaggggttggattatcatgccacagaatattacccaatgctttgagctgaggtcacatccaagattaacaggaagcactactcataaggacccctcccagggtggaagagaccatccacttaagggtggactgtgacagcctaatagagctgtgagcaaatgtgttgtgaagaaaatgcactaactgaagcacctgcttcaatttctaaatgtgactcataccatgtcagactgatccctgagctttagtttcttcgtcagtttaatgggaacaacagctcttgcactcatctcaaaggatgtgttggggattaaaatgagaacttaagtgaagcaatcagaccacaacataccttcaacaacttcagtctcactcatgggagatgttccaaaaataaatgctgaacgaggttccccataccaacacttcaaattattctccactgaaagactgtcataagaaggaggaggctgaatttcctgctgtgccctggaatgagatcactgtgtcactccatctaagttgcctggtcacaacttccaatgtgcaccattgactacatcctcctcatcagggaagggataagaacaaaatgatacctgtgattaacttctgcctagaactttatagtttatcaatcattcactctgagaagactctcacatcaactatgaggtattaccaccatttccattttaggaataagaagagtgagaaagagaaatggttaaggggttaaggaatgggaggcaggaagaaggctccagccttattctaaataccatgtcatgtctacgtttaagatgagtattagcaactcaaataagtaggtgaactgtgacaatcaaatgacaatcctgggttcactgctaccacttaggaagggatcagagaaaaatgagttttaattatagaggtagaaattaaggatattcaaagatgggagagtatactgataaggcaatcgtgcacaggaatgggttactaatgcgattatggggaacatctctcttggggggagaaaaatgtgcctgtaatcagataatttttatttgccaaattaattacaaaatacctatgggctttagggaaaacattaaaaataaccttctctgtccccgaggcatcataatatcccagatcatatctgacgggagattaatttttccatgctattcaattttaagtcaaatcaaatacttaccatacacctaatgtgtacaaagcatggtatagcagatgacacactatgcaatgtattcaagtaaacatattagaatcctgtagtgtaaataatagcaaagatgctatcctttgctgaaaggtgaagaggcacttcagagagacaagctatttcaaagaaatgattttaaagaaatgtttcaaatatcaaaattattgagatgcatgtagatttatccaggcaaacatttctatgtgtttgtacgtgaatgctcatataacatttaatgccaccacaacagtttcattttctttaaaatggttttctggtccttagtaacagaagtctgtcacatatatctttggttctccattctgaaccaagtcaacttcatggactgtttatttcattatggtatttgctaccaccaaaagtatcctctatctttcttgttggggctttatataggacaatttagaaaggaagaggtgggcatgtgcacggtgactcaaatatatctgtttctatagggagataaaaaagattcacattgactcccacactgagatgcattttgtctaaaggtactggaactcattaactctatctactccctcctttgaccattatactagaatgtgccccagcaaaatgtcctcttccagggcaaattctcagattggggaaaagtcaactagctctatatagggttaaaataaataaaaagtccttgaatatttattttaaattgttacctcgagacatgacttttatacaaagttaaaaataaaatggcttctagtaaagacaatggtggttgtggtaaaggatctcaggaaacaaggacctcatagttctaaccctcttcttcatcctcctcactggacactcaaaagctacagcaggcaaataaagtccacactgggtgccacaggcaggaagttccacctgatacggccacgaccaccctccatgatctcacctgaaactgcctcccttcagctccttcttgcccacaagtcctttctggtgcctcccactcaacacctcctccctagggtcttcacatctgctattcccttagcctagaatgttttgtactcccacccttccccatctcatcagctccagtcatcctttatatcacagctaaaatgccattcctggccaggcacagtggctcatgcctataatcccagcactttgggaggccaaggcaggtggatcacctgaggtcaggagtttgagacctgcctggccaacatgccaaaaccccatctctactaaaaatacaaaaattagccaggcatggtggtgcatgcctgtaatcctagctactcaggaggatgaagtaggagaatcacttgaacctgggaggcagaagttgtagttagccgagatcatacctctatactccacctgggcaacagagagagactccttctcaaaaaataaaataaaatgaaatgtcattaccttagggaagccttcactgtatcctacacaggtaaggttcctagttatggccccattacatgttctgatagattcccaaacacctccttccaaaccatgtaacacaattgtaattcattgtttgtgtagctgtctatttaggaactatcatgctagacaattagctcttgaaaccaaagattaaatctgtcattgtcacttctgtatttatattaggacagtttctggcacatactgagatcctaataaatttatggaatgaatgaatgaataaactgaattgaagaactcaaaaattctcaaaccaagaaattttctcctttaattctttttcccaaatcaaacatgagccagctgactgaaagccaggattagcaaaccatcagctacactgccataagcctcagtgaagatcaaagaagcttcatagcacaaagctaagggagccatctcttgaccccctgatcacctggacactacttttatgtctcctacaaggcctgggataagctacagccaaaaaaaaaaaaggaattctcttttgctcccctgcaattttactccatccagtggcctctgacctggtctccagctcactgcctttgataagtagagaattttctctactagctaaaaggcataagggaggcattctcatgagatgaacttgcttgtccaaggtcagccaacatgcccatggcaaggtttcttatttaccaaagcagaagtgaaaactatcatgttgtgagaaagaaccttactgtaggcaaaataagcatgtttaactctaaattatccagaataaaactttaatgagaatctcaaactatggagatgaaattaattaattttcttgttgaaaattcaacataaactccaaatattattaatatttcaaataaaacttttagtgaaactgttttataggtaactccagtaacataaaagctactttacaactacaggatgatgaaatcactgcacaatatattcttagctaattctgacctgtctgactttttaactttctccaagctataaaaatcaatataatctagaatatataaagaactcttcatacaaatgaacaattaaaagacaaataatccaatttaaaaatgggcaaaagatctgaataagcatttctccaaggaagacatacaaagggccaataaccacataaaaagatgttcaacatcatcagctataagggaaatgcaaactaaaatcacaatgagataccacttaataccccctagtacggctataatcaaaaagtcagataatagcaggtgatggcaaggatgctgaaaaactagaacccttttacactgctggtggaaatgtaaaagggtgcagcccctttggaaaacagtctaatagtcctaaaaaggttaaacataaatttatatgacccagcaattccaaatctagtatattaacagcagcattattcatattagccaaaaagtggaaacaacacaaatgtccatcaactgataaatggatacacaaaatgtggtatatccatacaacggaatattatctggcaacaaaaggaataaagaacagatacatgctctaacatggatgaatcttaaaaacatcacactaagtaaaaaaaaaaaagttgcaaaaaaatttatattatatactcctatttatatgaaattaaataggagtgattgcctaggccagggggatctgggagaaatagagaatgactgctaatgggtgagtttcttttttaggtgataatatgtctcaaactaattatagtgatagttggttatctctttaattatactttaaaaatcactgaattgtacactgtaaatgattgaattccttgatatgtgaattacatttcataaagctattttaaaatttcagactctaagctgttaaaaccaaagtgccagggtctttaggtaccttatctccaatcttaaatactttaacattgtctttgaatttggtcttcgattgtaatgtagtttggaaatttgtccccatccaattctcatgttgaatttgtaaaccccaatgctggaggtggggtctgatggaaggtgtttggatccctcaaagcatggtgctgtcttcgcaatagtgagttcttgcaagatctggtcatttaaaagtgtgtggcacctcctccccattctctcactccattgctcctgctttcgccatgtgatgtgccccttttcctgttggccctctgcaatgattgaaagttccctgaggcttcaccagaatctgagcagatgccagcaccatgtttcctgtgaagcctgcagaaactcttttctttataaattacccagtctcaggtatttctttatagcaatgcaagaacggcctcagacaaaatgttaaaagggaaactggagtttcttgtggcttaagaaattatgcaattgaagactgctataccttgaatgagatgtccaggaaaacacttccaccagtgggttagtatctccctttttacgtgaacagacggttcaccagagaggaactccaagtggatgctaagctaaaaagcttgcaaaaaattaaagaaatgcaagttaaaatgaaattcaatctttttggcttacaatactgataaaaagaccaggattggaaaatttgtggttaatgagggaattcacatgcactgctccaggaaacagaaatttgtacaaccatttggaaggcaatttggcaatagctattaaaaattttcatgttcatatccttttacttagaaattctcttctaggagtttattcttcagacattcttgctcaattgggtatttgtaatactaaaaaactggaaacaaaccagatgtaataataaaagattggttaaataaaaatacagtttgtccactcaatagaatatctgatggttgttaaaataatgaatggagccaggcatggtggagtggcttggaaggctgaggcacaagaatcacttgagcccaggagttcaagttcagcctgggcaacaaagcaagattctgtctttaaaaacaaaaacaaacaaacaatgaggtggtttgacatgtgctcacatagaaaggtggccaagatgtattgttcaacaaaaaaggcaagttaggatttagtagtatgtgctcacaatgttaatacattcataggaaaaataccaaggaatgtattctcagtttaatgacatatcttagagtgatgggatttccattttctaaattacacatatctttcaagttttagggtttttttgttttgttttgtttttgtttttgtttttacaaacaatatgcattagtttcacaagcacagaaaggaaagattttttttcaaaggagaacggtcccttccctttgtgtggttcactgaagcatggggaggagggtggacaggagatagaaattacaactgtttccaataactaggaatagtggctgcttcctaccttccaccataaaaagtctctgccccacttttctcatctcccacagcccttcctttctctactctcaaacttaacgactccctacctcaagccactgaagagtaatcagttcccctgcctttaccctgttagggcacaagctcctagaagacaaaggactctgcctaggttatctccacagcccaaaggacaatgtctgtacacaatgttctagagagtttcagcagcatgtcggggcttttaagaaacagtttttgttttaaaagtttttaaatggtttttgttttaaaattcaaagagtacaaaaagatacagttaaaaaatgggccgggcacagtggcatgcacctgtagtcccagctacttgggaggctgaggcaagagaatcagttgagcccagtaggctaaggctgcagtgggccatgattgcaccactgcactccagcctgggcaacagagcacatatctgtcttaaaaaaaaaaaaaaaaagaagaagaagaattctcagttcccagtagcccatcaatgaccagtgtcttggctattctttcagacaggtctacacaaatgcatgcattcctgtggccccttttccttatgtaaattgtagcatgcactctgttctgtagcttgcttttttccacttacataatgatgcaactgtttcatattggtacatacaaacatagttaacaacaccttattattttcttaaatgctttccaatgttgcatcttatggatacaccataacttagccagtctcaccccacagatatcaagtttgtgtattatttaggataaggtccagctgtactcaagataacagcggcttaaacaaaattgtctttctctatcacaaaaatctgtggaaatagatagtacttttttacaatttgatattataaagttgctctggtactttacagtatcaaatgcccatgtcttgttactccgccatgcatggcctcattcccaagttcacccatggtcccagacagctgctccaactccctcccagtgtccacattccaggcagcagaagaaggggggacaaaagagaagacatgcctttccctttaactgtaattcccagaaggtgtatactacgcatacttacatcccattggccctatctgagttatatgggcatactttgtcacaaagaaggctgggaaatgtagtctttactccagacagctatgtgcccaccataaattgagtttatatatgttgctagagtatgtgggggaaaatagaattggaaataatacagtctctcataagttacttccaatgctgtgaaatttaatcaaagcaacaaagaacattcctatgtatctgcttttgtacacttatgtgagagtatttttggacaactttctacaagaggaatataagcagctttagaaaacctattccaattatttcattttacaaatgaggtttaagaccgaaaggggtaaagtaacttgccaaagtcaaacaatagctcccagaaaagtagggttgccagataaaatacagaacacccaacgatattagaatttcagataaacaacaaataatttttaatgtaagtatgtcacaggtaacatttgagacatacttatactagaaaagtatcccttgtttttctgaaattcaaatttactgagtatcatataaatgtgtgtatatatacatatatatgtcatatatacacatacatatacatatatatacatatatgtgtttgtgtatatatatagtttgtttgtttttttagagacaggctctcattctgttggccaggctgtagtgcagtagcggtatgatcatagttcactgtaactcctgtgctcaagcaatcccctcacctcagcctcctaaacagctaggactgcaggcatataccaccacactcgaataattttgtaatttatttgagacaggatcttgctatgctgcccaggctagccttgaactcttagcctcaggcaatcctcccatttcagcctcccaaagagctgggattataggcatgagccaccatgcatggctgcatcctgtatttttatttgctagatctgccaactttacagcagaaccaggtttagaacttaaatctgctgatgtttagtcccagttcttcctctgtacaagatggccatgtcaagtgggcacaggtaataaatgaggtggagccaacaaagcatactacaaatccccaggcaaacaaaataccttcctaccgcagggctcaaacatcatgctattcatgccatatgcttaatgaattgaatttttctgtcatagatacatgggtaacaaaccagccactctacagaggttacagtaaatgcttcaatccaaaaccattagagcctgcgtacttctattcaaaataacattagccttacattaatgcagactcacagaggctgaaagtaggcaagtccttccagagttctggcttattacacatgcagggaaggatgcaagcatggactatagatatgctaagcactcaaaacacctttgaaattcacagtcacttcatagtagttgataatgtcaatgtcggcatggggaaccaagctgaaaatctcaattacatcaataaattatttcattacattctctatatatagcttaaaaaattaaaacttcactaataaattagaaccttcccatatcccttcttcatgattataaatataccaagactagataaagagtactgcagaatgtttcatataacaagattttacaggtacattttacaacaaagaaatcaagaaccttagttctaagcacattttttattccaaataatgtatattatttccctaaaagagaactaccctgaagaaataactttccaaaatttagcacaaacctctcccatgaaaaaaaaaggaacttggtttttattcagcctctagattcaaccagaaatttccaggaaacacaaagaacagagtaacaatttaaactctctgcagggatgcaatcaacaaaatccaggctggagggaaactataggacaaacaatctggtctcttcaataactaaataacaaatggaaaaaagtaagtgagccttttaaaatattaaccaacacaatgtgtggtccttatttgaattctgatttaagcaaatttcaaaaaaaaaaaactatagcacttatgagacaactggaaattgaacactgcctgaatatttggtggtattaaagaaatattgctaattttccagggcatgtgataacagtattatatttagaacttttttaaaggtccttatcttttatagatagagactaaaacatttatggaggaactgataggatatctgaaatctgcttcaaaatattagatgaggagctggtagttggggtttggatggtgtagaagtgaccacaggttgatggattaaggaaaggtgatggttatgggggctgagggggtcacagaaatagaaacactattctgtttatatttctccatgtccaaaattttccataaaatttttctagtacatgccaaaaaattaaactaaaatctgagcagtatagttataaatatctgaaatatagtaatactatatcagaagaaaataatttaagcaatttcactatttcatatcctactgtgaacaatgcattaatccaaaaccctgtgtgctgaatatttttcagaaggaagggtctgacttgactgtaatgaattaaaaggaggaaaagtattacatgctaaggttacttcaagcacatttaattttcctacaaatctgcaatatcaagaccttttttctaaaaaccaattactattttccaccaataaactgtaaacaaaactctaatgaatgactttgctaatacctgtttttactatgttcattactctgtggcccagattttagtctgatacgtaagtggaacatcaatcaaatatcaaaagagaagaaaaatttagtctgacgtatgctaagaaatctatgttccaaacttctttttaaaaagggatgccaatgagagaaaccccaacacccatactgtgaaacaatttgtatcagctttattaaccacgatcttgcaaaaaaagctactttattcttgtaacaccctctctggtttgttttttcccactagcaattgcatgaaaagggaaaagcaggaaagtcccaagactgtacaatctaaacaatgcctagggaaacagtctgtgaacttttctagctctacttgaacctatgtatcacaaaagctcgaataattttcaattaggccagtgctaccactacctggaggtataaaatgcatactgcctttttaccaataaacattgtttggtctaggcatcttgtgaagtaagtagactacacaggagttagttactcttactttacaaattaatcaactgagattctgaattaacagatttttcaagaaagagtaaaagagtggttgacttaaacccaaattccctaaaaactagtcccaatattaatccatctccccacatgtaaacatatggtcatgtataaatctttttgtatgtaaattatgctctgtaacccaatcaatatttatttctatcatcaacatccttccatacatcaaagcctactttatcatgcagatagctgcagaatattccacagcagaaatgtgccaatctttgaagttgcatagtttcattccaaatttcaatgatgttatcataaatttgcaggtatatatatctacatgaatctgtaccatttattctgcagaatttattctccagaataaattcttagaagtagaatagctgctgggcaaaggtgatgcaaaactggagcttagcccaggagggttcttgccttcacccaggaaagatttcaagggcaacctagtggtgttagactgcaacttttattgaagcagcagtgtacagcagcagcagaagcagggccaccccataggcagtgtatttttctgttctcacactgctaatacatacatacccgagactgggtaatttataaaggaaagaggtttaattgacccacagttccacatggctgggaagcctcacaatcatggcagaaggcaaaggggaagcaagacatgtcttacatggcagcaagcaagagagcttgtgcaggggaactcccatttataaaaccatcagatctcataagacttattcactaattcactaccacaagaacagtataggggaaccacccccatgattcaattatcttcacctggaccagcccttgatacgtagggattattaaaattcaaggtgagatttgggtggggacagagccaaaccatatcaggcagtgtgcccagagtggcagctcaggggcagttctgcagctatatttataatgcacttttaattacatgcaaattaaggggcagattatgcagaaatttctagaaaatgggtagtaacttctaggtcttcaggtcattgccatggaaaggagtggtaacctccctttgttgccatggtaatggaaaactgacatggcacagatgggcatgtcttatggagagatgctttcatctcttccctgtttcagctagtcttctatctggtcctgagttcaaatccccatctccaaagtcaagtcccgcctcctatctcaaagggtgtgtgcacttaagtattgattataacagcaacctgccccctaggagggctagtgcaacttacaaccccactaacagtgattagggtccatctcacttctcctcccaccactgtgtattaagctttgcatatgatagctgaaacttcggcaatatgatagctaaatataatctcattgttttaacctacacatattttattagcagtaaggttgagcatcattccctaaattttgtttggttggttgtattttttttctgggaattgtctatgcttgttttcactaatttttctactctatttttaatcttttattattgatttataaaagctctgtataagttaaggcagggttcctctacctcagcactattgacattttgggctggataattctttgttgcaagggactcttctcagcactgtgggatatttagcagcatccctggcctcgacccgttaaatgccagtggcgctcctcccaactgtggtaaccaaaaatgtctccagacattgccacttgtccttggggaagcaaaactgtccctagctaagaaccactgtgttaagtagattaaccctccgttccaattacatgctacctcctcttggatccacctccccactcagtagaagtgcccttcttctgtattccttatagatggtcattgacttaaatactattctaattttctagatgccttctcagtaccaaacagctataactgtttcaaaactcatacaatgaaagtgaagtctaaactcttttaagttccaatagtttcagttgtatcctctagaattgcattgtccaatacagtagacactagccacatgtaactatttaaatttaaatgaaattaaataaaatcaaaaacttggtttatcagtcacactagacacctttccagtgctcaatagccagaagcggcaggtggttaccacatgggacaatgcagatatagaatattcccatccctgcagtgttccattggacagagctcctctggagccttgccactcacagtgtggtccacggaccggcagtatcggcatcatctaaaaacttcttagaaataaagaatcccaggcctcaacagacctattaaatccgaatctttattttaacgagatccccaggtaattagtgtgcatcctaaagtttgagaagcacagtaccgaaagacccaaacatctgaggtcacttatcaaatgttcactcattctagaagtccatatttctccagactaaacatcctcagcctgtcatcatatgatctggattccaaatccccatcaacccaattcttcactgttctctatcatcttccagtctataaaaggacagaagggaaggctgtgcttcaggaaaggtctgaaagtgagaccatcactttctttaagctggataccatgctgctttcaatacagcctcagtgtgcattagttttgtctacatttgataatttcccatcggccacatcgcaccagaggtgcataataaacttgtgatcagcaggttccttgggccttcttcatggaacttcatggtcacaagtaccacagacttttgcacccaatgactgggggtctttaagttttacaatgttctcaaatatattccatgtaaatgactgaatcacgtaaacagtgaagaaaagtattagacctatgacaacatctgtaagattctctcttgttttgtaaatcaattaatattatttttattcttctaaattaattctaatgatattaaatttttgcagtcattcttatccttttctcattttgctttatcttttctgtctcatccctagaaattccctattcgtattgccctcatcatgcatattaattattcagtgtggataaatgtacaaatgcactaggaaaatatatgtcgaatgactcctacaaaaaaggcaacttgggtaaatcgaagatatgcagggcattagtgggtacaaaaaatagaaaaaaatgaataagacccagtatatgataacacaacagggtgattatagtcaataataattgtacattttaaaatagctaagagtataattagattgtaacacaaaggataaatacttgagggaatgaataccccattttacacgtgattattatgcattgcatgcctgtagcaaaacatgccatgtatcccataaacatatacacctactatgtacccataaaaattttttttaatttaaaaaaaaaaagatatgcaagacaagatctcctttttaagggtctaataatccagtggaaaaaagaagttttcacacaaataattataacaacaatatacagcacgtgctatataagtgatacaatcaacatgctgtaaaaaattcagatgaagaagcacccaatttctggctgggataattagaaggggaaaaaacttctcagaggaagtagcatttgtactggtttgatggatggataggacttcaacatgtgggtgggaaggtttgggagaatagtcctggcagaccaagcgaacgtacaagcaagggagatgcaaatacaaataggttgactttggccaaagtaaaggatgtgtggggagaaactaggcagaaagggccaaagcacaaaggttggatacatttgatgatgaaaagaaaaaagaatggatggaggccaggcacgttggctcatgcctgtaatcccagcaccttgggaggctgagacaggcagatcacttgaggtcaggagtttgagaccagcctggtcaacatagtgcaaccttatctctactaaaaatacaaaaattagccgggcatggcggtgggtgcctataatcccagctactcgggaggcttgagcctgggaggcagaggttgcggtgagccaaaattgtgccactgcattccagcctgagtgacagagcaagaatccatctcaaaaaaggaaaaaaaaaaagaagggatggacccagactgggcagtagccctgatcaaagtcaatgttcacacagtatctaagcctgtctattattagggttgactgaaaggaaaggaaaagaatcaatgaatgttcattcataatatataccataagacacatagatacatagcatagatagatggatagatggatggagatagatagatacatagacagatagatagatagacagatagatagatagatgaagaaatagattaaatgtgttttaaatttaaatgtctggatgctatctcataatatgataatacagatctcctccactattggatatttaggttagttcccatcttttatcaatatttaacatagaacaattgtgatgaacatccttttactctgtgaacatgtaattgctagaagaggaactgggtcaaaggatatgaacttttttttctttttttttttttttttttttttgagatagagtctcactctgtcacccaggctggagtacagtggcacaatctcggctcactgcaacctccacctcccaggttcaagcgagtctcgtgtctcagccaccctagtggctgagactacaagcgcgtgccaccatgctcagctaatttttgtattttcagtagagacgtggttgtgccatgtcggccaggcttgtcgtgaactcctggcctcaagtgatctgcccacatcagcttcccaaagtactgggattacaggcgtaagccactatgcccagccacgatatgaacatttttaagacttttgatatacatttgccaatttcattccgggtagtaagtacccatttatacctccaacatcagtatgtgggtttgtttatcctacgtggctgtgtccatctcaccgaaagaaggtgggattctgaacactatacctccttctccagtggtgtgaggagtcagaccagagtagggaggggctacagtccccagggatgtacacaaaggggtcgaggtagaataaatttcacccccttgttgtaattgtggtgactcctcacactcattaggctggcttcatgggcatggcctgtggagcacacagggcccagacttagaagagctctgtgtttgctttaataaggctctgctatcaccatcttgtaattcctaataatttttgaacaagggccctgtattttcattttacactgagtcttgcaaataatgtagccagtcctgctcacaccctacagtgcctaggagagcatgatgcacataagagacattcaaaactttctctaacttgaacagtattattgtgtttataggaaagagagagggaaaaaaatcaaactcaatctcaataaatgcaaaaactcttaattttgttatacagaccaagagaaaagttagattaattagaagtcagaaagttgcagaggaggcatggaaagaacaaactaaaaaaagttttaaaaatccagacagacaataattcagaaaaacactaagttcaaagtcaatgagaatcaggcttttctatatcatcttcccagtggattcttgaacttaataaatgtaatttctgcttggaaattttcctggaggccatctggaaaattaagacagacaggataagtgtctttttattattctgagccacataaaacaactcgtctcaagagctggtaaagactattccagaggaacccaaaccgctaatctcgctactcccaacaactttcacccacccccaaatttaatagactattagtattcctattgtgaacactgtcctttttccaagttttatttaaagcttagaagatcaaaaagtattagaattctgcagatggattcacaggagggaggccccagacttcatcaggtcagaagcattctgaggtttaagtccaagtccacttccttctcacgtcctctctaatttccattctgacattcttgagaacatgctcttaagtctggtctcaatcaaccacttcagaaccacagagggtatttcttatgaatgctgatttctagaccccacactggaccttctgcatcagcatttctgggacaagaatcagaaacctattcttttgaccaactttgggtgagtctatccacaaaccagaacttctcacacttattgtacacacacacatcacctggggatgttgtgaaaatgcaggtctgattcactaagtctaggtggaggggtgagagtctgcatttctaacaagccaagagcagtaatttccaccctgactgcacattagagtcacatggggagcttgtaaaaatcctgatgcccagaacaggtcctagcaattgaatcagaatctctgatgatgggcccagggacccccctggaacacgacagcaggtagatacaccctaaacctgtttccctgtactcccatcatactgcccgtcacttcagatgcacacactattcccccaccaccagctactcccttggccttgctaagtcctactctgtcttcatgctgcagctcaaatgtcacctccacagggaagccttctcaaccagtgtccctagcacaaagccaaaggaggtccctgcatgtatatggcttatagcaccttgaacatccttcaaagcgtcacacattttataatgatgtatttttgtgtcagtgaagaaataatgtccacctcaccccaccagcccttgtgagactcgggataccttcagtcagaggatagccctcaactcagcactgtaaccccagcagcttcccagcacttcataatagtaaagacaaacgtgtggagttgccttcctccgtgctgggctcttctctcagcactttacaaagtaatcctcacataatcctgaggtaggcacaattgttatccctattttatggatgagaaactgaagcacagacagttgcttgcccaaggacacagagctgaaggttgccagtggaggaagcaggatttgaacccaagcaatctgggttaagtaagggagataggcataatgtgggactacagagattccctggggactccctcccccaaacacacacacacacaccccatatacgctcacatcccccttccctgacacacacaattacgcttcgtaatggtcacaatgcctggagagccatcactcatccattcaaaataaatgtactgaacagtccctggtataagagggacattctagaaatatatgagtaatagatatttacttatctattattagacagacaacagacgaataagcaaagacattgcaataagtgtggcgaaagaactaaacgaggtggtaaggtaagggctggcaggctccttcagacagcgtcaggagagaagggctccccgagtgggtgccatctggctaaagcctgagagggcagtaagcccgctgtcccccaggagcagcagcaacgcaggcagggcagttgcaaaggccctaaggcacagctctgcacgcgcgcctgaggaacgcacgaggctggcgtggccaggagttgggagtggtcaagacaaagcaggtgtgacgggcaaggatcaaatcacatctccatatccaggatctcttctacccatgttgtcatcaatccagtgaccaaaacacctaccagtcatctcacacacgctcctgtgttcctggaggcctgcggctcccgtgaggcaccatgcctgctcgctcactgggccagaggcggcacgtgacctcaaagtagcccatcctcccggcaacctagggcttcgcattgtatcaacactctgctcagagtgtatgcgtgtatgcatgtgtccaggctcaccaaattgtatgcattaattatgtgcagggttttgtttttgtttgtttgttttatatttaaaaaaatataatcaaactaattgccagccaagtcagtcatcctcctgggaatatatagagtcccaaggttagcgttcctgtattagactatttcaattttaggaaaatcatgactgtgtggggaaacaatgactttaaaatgctaaaattaaaatttatgctttaactgggaaaaaaaccattgcattgtttgtttgcataccaattataccaaactaaagctagacagaaaaaaaaaaaaaaaaaacctctgctcacaaagggctggtgatatttaaatgaactgatcagattctctcaggaattttaccagaaatataagaataaggcagttggagatagggagaaaagtagacagggagagaaaaaatcatagctaggatattttaataactgactcttgaataaagatctaaaactcttaccactacagcccctagtgaccccgtgtatcttcaactccctgacccccagctataccttggttcctattatcagatttctagaagattccagccctcttaataccatttgtgtaataatggcatctgttgaacacgtactctgtgctctgtgctgtgggctttccacgctatctcatgtagtcttcactagaaagtgctgaggcaagaatcactatccccatttttacagctgaagaagcatctctaagaagttggcttacccatagtcataagctgttgtgggcagacctgagactgcaaaagtctgtgctgttcctattttcttaaaatgaagcctcattaccccagttggcctgggtgaggcttttttccttataacctgaaacagagttatctttttcagtgtctaagtattagtgccagtaattaaaaagcgatggctttcttaaaaattatatgcaaagctgtatccaaaatgtcaaattttgggatatatatagagagcaaactgatcttaatttatgtccctgtgatataaaacataaatttagtaagtgaactttggtgaaagatttaaacacaagcaataaagcatgtattcattaaatgtaccacacaatatgatacataaatatcaagccatatgaataaattaacaaaattactctatagagagctcttcccacagcacgatattcctgtaataataactaacatttactgagcacttactatgtgccaaatgacgtgctaagcactctgcttatagtatgtcatttaaacctcaccatgggagaaacagtaaaataacgccagtttacagatgtggaaacagaaactcgaaaagaccaaatagctggttagtgatgtcaagaattttgagttttctgggggggttgtttttagaggcagttttttgtttgtctgtctgctttggttttggtgtttgtttggttttgagatagggtctccctctgtcacccaggctggagtgcagtgatgccatcatggctcactgcagtagaggcaagttttaaacacaggtatgtctgcctctagaggccttgctcttaactactccaagtatcttgattacagcagatatcatactatgttgtgatagattatctgaaagtctgtcttccactatgttcccaatttcaaagtatttacatcctctccttttcacttgtccctccttgcccaggatacagtaggaatatgatatttatatgaatcaactagctgatctattagtaacacaagacttagaccaataatcattcctgttgaatcaagactattgggtgaattttgcaaggtgatgaattatctcagaaaaaaaaaaaaaaaacagaatccagaaagcttaacctcaatttagttacaaaactcaaactacaatcaattcccaagcagaagactgttgagtttttaccttcttattaacagattgatttgtgacaattctgtgccactcagaggaaagagaaaaaaaactgagatctctgaaaatctctcataaaaattatctgtaaataacaagaaagatgtcgaaatattaacgcctcctccatgagcacatcaaaatgctccctctgccaccttccatctgcttgcctgcctcacccaacgtgagcacagccccactctgctttcagcttctcttggatgtctaaaaagactgggccaaaaattgtttcagcacgccggaaagtataatcctcacatttcagacacatttagataccctaatttaaaatatggtggaaaatagcatacttgcaggctgttccttgctatagtttaaatgcatccctcacaaaattcattcctctgttaaagtcatatgcataaacttcacttctaaatggaagtaacaacaacaatagcagctaacacttacatagcattgttctcagcactctatatacagtgattcatttaatcaccttatgacactactctttttagcaccattttatagggtagaaaactgaggcccagaagggtttggtgacttttccaaagtcacagggctggtgagtagcagagccaggacttgaaaccagagctatgaactccagatactatattcttaaccactgcaccaaactgcccagggggcttcagccactaactagcttaatcctttcttctccaagatccctggttgtcatactgcaacagaaaaaaagctggagggtgagtgtggttgattgaatactggccccaaaaagcatatgtccaaggcctaactccctgaacctttgaatgtgaccttatttttaaaaagagtcattgcagatataatcgaagttaaagatctcaggatgagatcaccctggatttaggacaagccctaagtccagtgatgggtgtccttataggagaaaggtagagggagatttgacacactgatacacacaaaggagaaggtgatgtgaagacagaggcagagactacaatgctgcgtcaacaagccaagggctgctggcagccaccaaaaggagagaggtatggaatgtattctccctcagagccttcagaaggaaccaaccatgccaacaccttgatttcagacttctggcctccacaaactgtgagagaagaaatttctattgtttcaagccaccaagttagtggtagtttgttatggcaatgctatgaaactaatataatgagtcatggatcaaaatccttcagcagaaatccacatccccactctacagatcaggaaactgaggctcagagtgaggacttcattggcacgctgtcaagcacacaaggggtttgtggcagagccaagccaggctctaggctacatactgggtcttcggacatctggactagccccttcttcagtatctcatatctaccactttgagagacataatcatgcagtgttcacagacgggcactttagagtccaaccacctgggttggcttccatgtttggcacgatttgtgagctgtatacctcaaatttctcatctgtaaaacaggaacaaaaatgacacctacatcacagtgtcattataaggagcaagtaagtcaatacatgtgcctggtatgcagtaagctctcaataaatgttagctattactattattttattctaatatctacttaattatagataaaggttaaactataaagtcaggaatatggcagtgcctagaaaaaaatggatagacatattaacaggatttatctttacgggtgcacatttgtgacaaatgctattaactaatttcttatgtgggggttggacatcaagaggtaatatctatcaccctcaacttacacctcttagccagtccttactggccctgatggaaaaaggagtgcctaatatgactagccagagaccaggacattgactaggacatgctgtgctggtggacagggtcactgtagtgcaaaaggcccacagctgtgcccctcactccaagctgcggacccgaacaaggcaagccagccccaagcctcccactttcatgctctggcatggtgaccactcctggaaacactgcttccccaggcagcactgccatccacccagttttccagcctctcaggacagggccttgccaagtcacctttattctttcacttctgggcatccatgtggtaagcacactacagcctcctctcttgctaacctgatctccccctgagcatggtggctgcttggggtcagcgcacagcaggtatggccatcttgggtcctgggaatggagggagtagcaagcttccttacctaatcaaaaaatccctgcatggaaggacactgagcccatcctcagaattaataaactcatcctccgtcttccatttgactactggtctctaagtgcatagtccccttggtcagacactggggagaggaaaaagaacagtggcattcagacaccaaaaccccacccaaactcctaacaaatttatattaccttctgatggaaaatgtgtatgataagctatattttttcaaagaataatgctcattgcacagtgccttctgacttattgaatttcctaacactcttctgaatgatattgcaggtttgaagaataacaagaacatgaaacacctcgggaaatttctcccccaaaccaaataaccaccaatctgttgttgttgttactccgctttaataatagcactgggcctatgcacacatgtgcacccatagaaaccacagcccttgtctgatcacttctaccccaatataaaaatccaaggtagttgctggaatgaagataaatactactggaattaacagtgtccttaggaaaggcagggttgggatgctgatttcatcacaattctgcctgtactttttcaaggaagttcaagaaccatgggcagctgtagaaatccaagtcatcagaaaagcaaacaaaggcagctcctcccccgcaaagcatgttccctggaagggcctctgcatctgccttcttagcataaagtagtggtggcaccttaatctactgggaacttttctgcctttccttttgttccactcgaggccaggcaccagactttcatcattatccataatcatgtcaactctctgacttttgagaattaaccaatgcctgctacaccttactcttttctccttccctagatatccaaaacaaggccctttcccattttctggttctgtgggggtagctcttaaattccttgaagtcaagagaattattaagatgtcccttctggttgggcacggtggctcacacctgtaatccccgcactttgggaggccgaggtaggtggatcacgaggtcaggagatcgagaccatcctggctaacatggtgaattatttagactctactaaaaatacaaaaaaattagccgggtgtagtggcacgtgcctgtagtcccaggtacttgggaggctgaggcagaagaattgcttgaacctgggtggcggaggttgcagtgagctgagatcatgccactacgctccacccagggcgacagagcgagactctgtctcaaaaaaaaaaaaaagaaaagaaaaggaaaagaaaaagatgtcccttccactctctctctctccctctctgtctctccccccaggtacagagttttcactcaggactctgtgagaccaaacaacatccatattttaccaacatttcgaatttaaaaatgttcttcatttcacctttaaactaaaaatgtacatctgtcaaccaaggggtggaccagaggaacacggagagacaatgtcctacgtaaggtaagcagcaatgcttagctccagctcactgggctcagggctaccacatctttctggtattcagggaaatgaagaaatgcaggtttttacatgaagtcctccagttttcaatcttaacaactaattccccaggtcacacagccaacttgtagcagagccagaattggacctaggcatcctggcctcatgagctcaagaggccttagctctgtatatatttgtacctttcattcaacaactgtatactaaaaaactgctatattcaggaatgttattttaatgagtggatggatggatggatagatagacagatgggtacacaccctaatatttattaaggaatgaagggagaaagtaaaatataatttccaaatttacaaaatattttttaaaaactgagacaaaacattaactctataactatcatttttcttcctaaaataattttatttgtaattgactctgaatagggaatagatcacacagtccgaatgctgaaagtaagggaaatatagaaattgtatttaagccagggcatctgccatttaagaaagccatgagtaaggaagcactgtagctttggaatccacaggtaaaaccttttcttggattatttaagaacaacctcttttcccctctgcactcttgggaggatagggtatatttctgtagcatttctatagggatggtaattagtatagctgagaaatgccatcaacagcaaaagtaaaattagcctttacttgtaaaattttctcctggggaaatgctggtagctcctgtctccaccaagcatggtaatgggcttgctgtgtcatcccattgcaagcaaatcaccccatcagcagcgcttgaatagaaccaccagcacaacaaataggacagccaacacaaatacttttgcctgcttcaactacatctgcctcaccctggccccatgccctcatcaaatcgcactcatgagtcataacagcattgactttcttttgtcaccaaagcactcttaattttcctgaaaatttttgagtggcttggagccatgacacgttttaaccaagttgagccttggaaacaattgtattcagtatgatgatgcagcaggggaaactgaggtccagggaaaagacgtgatttggccaacatcacatctaatttggcatcaaagccaagtctaacttaattcctagtaggggctttctctttttgatgtaccaagcagtctttttaggttaaaatttacttctactccacacctactaatgtctctttatctggaccttctctgaccacctcctcctgaggtttgaagaatagaaatctcacctcctgcccaaagctgatctgtctccctactcttccaggcttggttccatgaaaaacccctcttcatactggcccattccctacaagttaaaaatatggtcaactatgtcacacaaagaaggcagggagagattccccaaactatgcatcttgttcagttaccacccttcaaagctaacctccttgtgagaagagtataaaaagcaacattaacacttccaagccactgcagccccaaatccaccctaaccatgccatgatgatgttctggcagagaccacaagaacgcaaattccaccaaacccacctccctactcaacaacaccacttggataaatgacgctttgccaacaacaaaacatgattaaaaaaaaaaaaaaaaaaaaaactcctgatctctctctctaaactgaaactgttttacccttggtcttccccagtggctcaagactccttttagtacacccacaagaatgaaagctccatacaggcaggaagtttttttctattactctaacctctgcacctagctcagcacatggttccatgtttattgacttaatccatttcagtcattcagtcatcatattgtttgaccttctggggtggcaccagtgaccttgccagtagaaagtaggtagacatatctaaaggccggtgcagagatctaagttagagaacttgactggggggatcatttctttggtacaaactattgaagtgtcattataagagtcttagctggccagatattatgcagcagatggattctgtagactgagatgagcaaaataggccaaagtttataaaaaccaatcaatcaaacatctcctctgagtcctatgtttctagctggttggattaatatatatagcttgctagatctggaaaccatgtgatctttctttgggcaacataagcgtctgccttttctgaggattcagataatagtgtttactgggaaatcaccctcatctttttttctattactccctacaatgatagtgaatttatcgtttccatctcatgccgtgggacatatttcaatgtagcataccagaaaaatgtaatgtgagtctttcctttttttttattttttgcacaagaaaagcctagctgtggctcagaattgtccagggcagccatctgaaaattaacacaaactggcttggatccagttatgggagtcaatacctatgtcaagaaaactctcctagccattcctaagcagctcatctgaacttggtttcaagagtagggtattctaattccactgactctataaagggtaaagaacaataggataacttaaactattaccacatctattttacaggtaaggaaacaagtgcagagagataaagttaaccaaattctcacagctagaaaggaacctaggtaatccatctccaaagctggtgctctcgaccaccatcatagaaaacaaagcaggaacccagaggcaggctccactaacaccatgttgccagttctgctcacagaaactctttgaacaggcagcatatcagatgcaaaggcaaaaactagggctactaggattacaatgtaagcatcatgtagtaatgtcactacatgtcctacaatgagggtaggaaacatctgataagtgttaagtagggttcaagattagcaccaagttgagactatcccatttaggttcatcagaagtactgaaataagatttggaaaggggccggggcagtggctcatgtctgtaatcccagtcctttggaaggccaaggcaggaggatcatttgaggccaggagttcaagaccagcctggccaacatagcgagaccctgtctctacaaaaaaaaattgtttaataaaaatattaggtgagcatgttggtacatgcctgtagtcctggctactcaggaggatgaggaaggaggattgcttgagccctggagatcaaggatgcagtaagctatgattgccactgcaccccagcctgggtgatggagcgagatcctgtctcaaaaaaaaaaaaaaaaaaaggattcggaaaggggatgacttccttttacatgggcttcaaagttgtttaattcagagtcctcacctgtcctaagatcctcttgtgtacacagagctactcactccatactacagtcaatcctgacactggagactgactttggagttagtctgcctgggttcaaccctagctttgccacttgctaaatgtaactttttgacaagtgacctctcctctgaggcttgctttgctcacataaaaataaatacatataataataacagtacctacttcatagggtcattatgtggattaaatgagataccatatatgtggcctttggctttatttcatttagggaagtactttacaaaccacactgattgtttattattcttacttaccaggggaacatattgtagttaggtgggtacactaaatgggaaagtgaagtgattcacagactttacatgctggcctgagaaaggcaggggctcaggccttccccaactcccccatcccaaacacttccagaagccctacactggctggatgttaggaggatactgtgcccactcttagactctggctaggcttctacagaagacagagagaggtcacatcaatggctcttccagaaaggtaaataaactaggcaagaagctttcttccctagaccaaacttcatgctcaggtcaagttccaaggtagagtcaactacccataaccaacaagatatatcactgcttcattccttattcacagtctacatagaaaaaggaaatgaacctctaaggattttcacaagatggtaatgggacagaaagtgcactttacacttctttagtgtcttcttcagcccttggcatataactgggaacatgataggtacgtaattaaccctcacttgataattcaacaaaatcattcgttccttgctcttatcacaaatgcctacagcataactgcatttgtagtatgagatttgagttacaattacaaataagtgatatagaattgccagaggtaaacttggaattttcgtacccagagacaagcataatgaatggaaagtccttaatgaaaatatttaaagatgtgcttttactatgtgacacctaatgctatgcaaactctttcaaggtaacttattcctgaaggtagactaaaatccaccacctccagtatattgtatctgaatacacttagtgaatgcagtacagtccatcagcaagtttccatcttaccaatgtacataccctttatcaccaaaatcctggcacatgccccctatttctcagcacaaactgaatagcagtgaaatgaagacatgtctcatattaccaaaagctcattcatttcactaatcactgggaactatttactcccaacacatgtgcaatattttatgaagtggtaatatctagacagaggatcttgatctaaatatcctgagatgcccttcgagtttgcagtagggatgaggaagtgaaatttgtgcacaatccagattatgcacacctttctagggaaaattatgacattttcatcagctctcaaagtgtacatggcttcccaaaggtaaaaaccccgaagagaaatttaaaatttttgagaaggcaattttatttattatttggtacatttctaaatttaagcaagttctaaatctggccatcatgtgcactgtccaactctccatctcataggcttattgatttctattggtcttaggattccttggaaacttttatattatttcacatggatattttagaaagattttccaagggatgaatcggtgagttttaatttctttccattccttctcagataatatgtactcacgagccaatcgtttttagaacttaagtggttatacttttttttttttttttttttttttggagacagagtattactctgtcactcaggctggagtgcagtagaatgaacacagctcactgcaggcatgacctcctaggttcaagtgatcctcccacctcagcctcacaagtagctgggaccacaggcacacaccaccatacctggctaattttttagtaaagacaggatcttgccatgttgcccaggctggtctcaaattcctgggctcaagtgatcctcccacttctgtctcacaaagtgctaggattacaggcataagccaccatgcctggcccaattatacttacaacgaaaaccatcaaattattacttacttctaaaagtttacagatcctaattagtatcattttcccatccactttggagaccaaagtctccaatgaaactaagggaatttgggggccgggtgtggtggctcactcctgtaatcccagcactttgggaggccaagacaggcagatcacgaggtcaggagatcgagaccaacctggctaacacggtgaaaccccgtctctactaaaaatacaaaaaaaaaaaaaaattatctgggtgtggtggtgggtgcctgtagtcctggctactcgggaggctgatgcaggaggagaatggcatgaacccaggaggcagagtttgcagtgagctgagatcgccccaccgcactccagcctgggcgacagagcaagactccgtctcaaaaaaaaaaaaagaaagaaagaaagaaagaaactaagggattttatagaaagtggagactgttttaattccatcaaggatgcactctgatagtatataaaagcgccatgtgggtccactatggtaaaataacatgaattgatcctggtgttggtcaatataacttccagaatttctctagggggcacaatgtaggtagggagtgaagaggtgagtgtggaggttagagattccaggaggctactgaagttgttattgaaatggctagttatagacagaagttaactagttatagacagaggttaacagaagctaactattcagactataaaagtcttctggattcgtcttggtcctcctaatactagaactaaggcaagcttctaactatgtgttgcacaagcatatttcccagcaatggctgtcctttcctcctcaccaccttacccacacactcccttgctagagaatctactcatcatgcccctttctcagaaagaccttttccatagctctgctgagggggcgtggatgtgtgactcattcccttggccacagctgactggacctagaagagactagacccaagctaggtcaattggattattggttctctgaatttgaagtcgcaacagcgcaactctaggctgtccctggtgagcacttgaatgaagaagatacacatgctttccttgagtgccgctttttcataagagatatataaaaatagatattaagagagaaaataagagtgatagagatgtgtatgtgtgtataggagagacagagcagagacagagatggagactggctttgttgatattcctcatcatcttccaactgaccccgattcccgctccatgtgacacctggctgccctacttacccttaatgtctagtaggtatcattatgtgctcccagtaaatccctcctccccactttttttttcttaaacttgaatgggtttctgctacttgcaaccatattctcccttaaatgagggagagtggataacttagtaaataaatggtctggattctcaaaaagaacaaaaaagatatttcacaggggaaagttgctggcagaggcagaaatcaggaaggctgggacccaagagaggaagatctgattttgagacacaagatgtggaacaaaagacaaagcctgcatagtgtatcaccccagtgaggtcagaaaccaactgaggaggaagctgagaggtgcctgttgaaggccccctggactaggaggccagcgaggtactctgaaattcctgaagatagaggcaaggacaggaggaattctaaatgattaatgagaccatcctcattgaagtccaataacccaaagtaaagagctgccctgtccctgaaactctgctcttgtagattcagggaatttgtcaaagtcacaaccacctgaaagggtctgccaggcctttaatgagcatcctgagagataatctccctcattcctttgccacctgtggttttaattttccagccagtcctggagttgcttcctcccatccttctggatgggtttccaagacaggagtgttcctttggcattctcctctgctcatttacttgacaagaatgtgtttgctacctcctgctggccctccctcctcgcctgttccttgcttccttcttcgttcttgctctctgtcctttctgtatacctctttgacagcatgctgaagatgctgtcaggcaacacattgcttactccactctatcttagagcttccatttcagccccagattccttggttttcaagcaagtttgatgtttttcccttcaagacagtggaaagagcacaattttagagctaagcatacctgagatcaaatcgcagctctattggtgaggcctcaggcaagtcactcaatttctctgtgacctgtttctcttgcataaaatagagatgccatgtgtcttgcagggctgttgagctcacacatggaaagaaactagcaaattcttggcacatagaaggtgctcaaaaatgcttacttcccctccccttttgtcagacatggacgaaaaccaccataaagtcagtgaaagtgtaaagaaattatagttttataaaataggtttatttcctttatgagttgtccatttccttacaagattgacacctatttaccaaatgtctacttctaaaagaattcaagatatttgaagattcatgattaccaatccataattggaagaatacatttttaaaaagacatcattgacaattcattctttcccacacaatgatgaatcatgttttagtttttatatcatcatttttacaaaaatacatgcattttgatcatcagttcacaaagtgaaagtaaagcactgagtgaaggcaaagcatgatatgcaaaatgaagttatagtaatcatctagttaactcagtttctcaaccttgtatctactggcattctgagctagacaacgtcaggggctgtcccgtgcactgtagcatgtttagcagcacccctgctctctactcactaaatgccagtagctaccatcccccaagttgtaacagtcaaaaatgtcttcagacactgccaaatgtcccctggagaaaaaactgcccacagttgagaactaccaagttaactttatcaacgtatggagacaaacgagacagctcacgcccagccatgggtttgtaagatgaaaagtagctgcctcagtctttacttctcaccagatctttcctactgaaaaacaaaatggctacacgttgcttccaaggcacaatcaagcactggcttcacagagaaacagaagaaattgcacgtgccagaattcggttgttagactgccccagctcttggctgcactcccacgctctacctaaaaacctacttcccaaacttttgaaatgctttccacagctttcagaacctgacctttacaacagctttatctgtgtgtctgtgaaatagatttacaattttctatgttcctgcgaggccaaaccacttattgagtccaaatgccaactgggggtggtgggaatttgcacacagatgtcaatggactccgaaacaacaacacaagagctccacctgcaactaattatagaaactgaaattgtgttctggccagaataggccacattcagaacccaccccatctgctttggcctgtaaaatcactctgttacttttctgctgtcaacatagacttgactcttaaaattctctgaggatgctgtcgatagcgaacaacagtgaatattttgggggtgaatgttttgggagtgaccactcctcctgcctttccctcttggagcttggtttcaataagtacccttggcgcaagtgagactaaaataatctattcattgaaataccctgattttttttttttggtggcttatgtgctgctgcaatcccgtcacccaaataaagtgatccagagagaaaaatggaagatggaaatcatttaggtctcccaaggtccagcacacaagaatgtttatttccctaccattagccaagtctttcagaagaaaacctgggaataaaaatctgtaaggccactaatgtggtacacatggctgattctagggccgactgcaagagattactgaggccaaaaccagctgacatctgtgacaaagatgtatagttcacttcaaatcattatcctaccttctagcaaacaaagaaaccagctcttggctctgtgccatctcatctatcttcaaaaccaaaagaagttttcactcatctctgaaaggcatttaaaattgtagtttccatctaagtaggtcatcatctaagtctggaccaaaatttttccagctctctggaaaagtagacaaaagctacagttctctgaagagctaaggaagactgtttcaagatgagaagatggactcatttttttgtccttctgagattcagcattccaaggtatgttgtggtgctaaactatattatccagttctaaatacgtgtgtttatgtaacattggggaaaacacacacaagcactcacacttcaactcggaattaaaatgaaacaccttacacacagacgcaacatatgattgacttcttaagttctcaggccccactatgactgataagcccttaaaacatttggagagcagaggtgagtaaggacagctcaagtcaaggcaattgacatctgtttttgtcttggagcatctggtcgcccttcatcccacttcctttagagaactgctcctctctcaacacctgcagttctaatagggtcaccaatcacagaaacctcttctcacataactgccccaaccatctccccacaaaacacacacacacatacacactcaccaagtcctggagggaggatatgaccaaagcaggaacagagtccctccatgaactttccaagtaggaagtgaagatgtaaggctctcttgacctttcaattgtgaccctagggtactggcaaccaagaccgcccaccacacagaggaaaaaatgagggtcacacatagacagaggcagacattgagaaccagagatgaagcaatggtgagagacaaagtcctgctacagtttaaggccctggatgcagtaaccccaaactccacacttgatcctttctgcaattttgttacaagaactaaccaactccaccccgaccctttttcttttttttttttttttttttggcttatgcaggctttgagcagcatttgtgtcactactttggagtcttgcccaaattaattagtaaggaagtttcttcatttgaatgtgtaaggtcctttaagatttcattgaacctccctgaaacatgccatggcttgttggggtggggggaggttatcaggactggcaattactatgaataacagttatcaattaacggtttctgatgttttatcaattggtgagctgcaagtaatagaatgaccaaacaacagtgacttagacaactctgggtttattttctcacatgactagacatctagaggcaggtcattgctgctgttggtgcaatttctcagagatggcagctcacacgtctctggacttgtctattgctttctttctttggcctttctttcatggttataatgtggctgacacagctccacccatcacatcaaccgtcaagacagaaagaatttgggaaggagaactgctggtgatatttgttcctttatcaggaaagaaaaagatttcctagaatctcccagatttccacttgggtttcattggccagatacttgaggaagaggaggaggagcctgaagctgagccaggatttctcagacttatactagtggaaagaagggagcctgagagaaggtaagggataagacaggtctgagaagtgagtacatctgagtcgctggcaccatcaggacactttggaaggcccagacgtggaaggaaccacatagaaagtgctcatccaccttcacagatctcctttaaggtctcacttcgagatgctcctgaagcagagcagcctttcccaaagtgtggccttatacccttatttctaggaatatttataatttgtaacagatgggactgttgttaaacatatgtatgtatattcattccactccccctctgccttggcagggagtaaatttcctctacatgactgactttgggcttggttacatcacatgctttagccaacagaatgttggtgaaaatgatgaaagccaaggctttaaccatgtttgtggggtttagttgtacatttggcatctgtgatccaccatgagaagatgaagccctgaatagctgctgttctgaggagaaggtggagacatggaacgtacctaaacccaacctccagtttaacccaactaagttgtagccaacctgcagatatgtgagggagagagataaacgcttgtctttttaagccataggttttgagatggcttgttacacagcattattgcagcagtagctgcctaatacgtaggtgcttagtttaagttttggcagagcgcagtggctcacccctgtaatcctagcactttgggaggctgaggcaggtggattgcttgagcccaggagttcaagaccagcttgggaaacatggcaaaacctcatctctaaaaaaaaaaaaaaaaaaaaaaaaattagctggatgtggtggtgtggtcccagtactggggggttgaggcaggaggatcacttaaccccagggaggtaaaggttgcagtgagctgtgatcatgccactgcactccagcctgggtcacacagtgagatcctgtctcagaaaaaaaaaaaaagaaagtttcacagtggagtaagattagaaaattggtgagttaagcaactttaatacatatttttgtttttcagggattttttgtttggttggttggttggttggttagttggttgattggttggttggttttgtagaggcagggtcttgctatagccccagctggtctcaaactcctggactcaagcaatcctcctgccttggcctcccaaagtattgggattacaggcttgagccactgcacccagcctagtaaacatttttaactgaaagagagcatttcatgtggtgatatgttgtagtagtctgcttatgttgtgggtcgaattgtgtatccctaccctcaaaaaaataccagtacctcagaatgtaaccttctctggagatagggtctttacagagatcataaatgaagtcattagggtagactctaatccaatatgattggtgtccttatgaaaaggagaaatttggatgcagacacagccacccacagagggcagattatgtgaggacacacagggagaagatgatcaagcactagccaaggagagaggcctggaacagacccttccctcacagccctcagaaggaagcaacctgctgacaccttgatcttggatttcttccctccagaactctgagacagtaaatgtctgctgttcacatcactcagactccaacatatctttttgtgggggatatacaattcaacccccacaaaacgtatgcattatgaatttccaggataagcatatccaatatgttgggtgttaccatggactgaccagaaaatccgttttgaaaagtgttatctccctgcacacactttggaaatactggctttgaaggatccatggtttcttagacttatagtggtagaaaaaaaggagcctggaagaaggtaagtctgaggagtgagtacatctgagttccacccacaaacctgatgaaattctatcactcacttccaattggcacaactcatcatatctggacactcacaatgaagttagtattttaatagaacatagttgaatgaccctgttgaaatggccctgcaggctgggggcggtggctcacgcctgtaatcccaggacttttggaggctgaggcgggcggatcacctgaggtcaggagttcatgaccagcctggccaacatggtgaaatcacatctctactaaaaatacaaaaatcagccgcgcgtgctggtacacacctgtagtcccagctactcgggaggctgaggcaggaggattccctgaacccaggaggtagaggttgcagtgaaccgagattacaccactgcactccagcctgggcagcagagtgagactcagtctcaaaaaaagaaagaaggcagaaaggaaggaaggaagggagggagggagggaggggagaaaagaattatttgcagttatacaaataaaacaaagcagtaataataaaggaaacacagaaatgtgatccatctcgatcttttcaaatttcatgttcaaaataagaatcaataaatcctatgttgaaactggatcaaaaactcatattaatattgatttagagtagattctttcctaatgtgttaagccaaaaatagaaatgatcacataaccattgtttaaaagctgtaacattccccagacaggtttacttacacttcttgggttacgtttcccaatgaccttgtcccacttctgcacacgcaagatgggtaaatattagatctagtacaatctccgagtgtgtggtgctatttatattcatgcagagccttggctagccatgcacaacctaggaaaatgtctaaaaattgctttatgtgtacctaatttggaagaaatccgttagaaatacaacgttaacaattgcacaaaataccgaggaatatgaaaagtcagtaactcttatgtaccaaactacaacacagaagtttttataaaccttaaaaagatgtattcactcctatgtttcctctctttgatctccgtaacacaatagaataaagatataaagaaaagataaacctatattcttttagagaaaataggttcactttacttcccaacagttgtatccaccctctcatcagccctgccccccataacacctatcccaacagcacaggccactaaaaataataaggggctacctcgcgtaacagtgtagtatggcagcagaacatcctttctcaatactttctcctcatccctcccccaactgttctacaggtgtgacattgagagcatgggctatgggttcatggcattccaaagaatcagctgtccataatcccttgccccactctcctccaatttaagaaaatatatcatgaagcaaaagcacaagtgacagcaccaagataacactgcatctgtgcaccctggtttatacaccaagataacactgcatccgtgcactctggtttatacaaacaagcacatgattctaaatttcagtgctgcaactcttagtagtagagcaaatgtatttatattcatgtagagccgcgtggctgagaagtagggccttggagggaactgggtggaggagaagtgggaatggaggaaggggtggcatatccatccaagaaactgagtgtcaaccctttgcacataagaaatttggtcacggccacctactcattagctccaaggttccaaatagtcctgcactccctgtaacacagagagggagttcagcatcctcccttagatctggagttgggttcagctcccttagacagaaccatgaggacttcaaaatctactgccaagaaactgatgagcaggagccctcgacaacgctgcatataagaaggaaagggctgggttagttagcattatatttataaaactatgaacttcctatacaagagcatttcaatctccttacctctaccctgtaatggacctgcttccaatttctcttcacacagaacagttcaaattgttttagatcattagaacttaggttagtgaaattctaaatatctaaatacccctgaaagaattaccttgatagatgcaatctctgattattgtggataagaaaccacaatcaaatgtcccttatcccttttgtatttctttcttccatatagaaaaagtttccatgatttttcctttaaaaggaaattaagttatggtaaatggtgaaaaccctaaacagcacaaaaaccatctctaggaaaaagaaataaattcctagttaagaatacaaattctggccaggtacagtggctcacgcctgtaatcatgccactccaaagagttagatgtccataatcccttgccccactgtcctccattttaagaaaacacatcatgaggcaaaagcacaagtgacagtaccaagataacactgcactttgggaggctgaggtgggaggatcacttgagcctaggagttcaagaccagcctgggcaatatagggagactccatctctacaaaaaagtacaaaaattagccagacatggtgacacacacctgtagtcccagctactagggaggctgaggtgggaggagcgattgagcccaggaggtcaaggctgcagtgagccagtatcgcaccactgcactccagcctaggtgacagagtgaaaccctgtctcaaaataataacaataatgataataaatcacattcttaatcatcttatcaaaactagtcattttttcatctagcatgtatgaagtaggatcttcctataatactaaatcacagctcagtgatcttttaaggaggtagtgatcataaagttaagatcttagactttggcatgaaatagaccaatgccttaagacctagctatgctgcttaccaactgtgtgaacttggataagttgcttattctctctacatttatgcttcatctgtaaaataagaaaagttctagcacctacctcagatgactgatgaaatcactaaataagataatgtacacaaagcactaagcacaatgcctagcacacagttggccctcaacaaatgtctactggtagcactagcagtataatagaaacaacagcaatagcagaagattgctccccaaactttatttcacctagctccatttttggaaaaacataaaaaccccactggtagtaatccaccatatatgtgtctctcctccctttcctggacagaagagaggactccacctcacactcccttcaattatgtcactttcagttcaaggaattaaagaaccaatgtgccatctccagtcactctcctcccctgctgtggcaacgtttgaagccatgcatcaggatgcagaaatcctggatcctgagtcactgcatggaaaagacccgtcccacagagtcacctgacctgcttcttactttaagcaaattagaaataaatctcaaatatgttaatccactgagatttgaagtttgttagttactgcagcaaaacttaccctatcctgaccaacaggtactcctatacttctaaaagggatcctaatatacttccaaaaagagaagacagtttttttaatagcttgttttttgtcaatctttatattttttactttgtaagacatcatattgcaagtaaattgacttttcaaaatctctgcgcttcttcctcattttacactttttaatctaaaagagaaaattgcattttacttgtattaaatatacagattaatactagagctttcactgagtcatatgtcacacagtcacatttcacctatgataccaaggtatcctgtgatcacagtaagaccagaacaaggaagggataatggaagtgccctcaagcattcacacactcctggcttatggcaacctgagacggttaagtggaattatggatatcacctattctaaactgaactaaccctcatgaaatggacaaatggttcgaaatgtttttaataaaagtggaaaaggttttatatgtcactaaaatgtatctcaatgtattattttgctctatctcatccacatttaattcttcgtggatgtcataaaagacacataatacactggcagtgtaatgcatcctgtaatttataaataaatatacatgtataattggggtctgtgctcaaagataaacttaatgaaagaagcatgagataagtcactttggagctaacagtttaaagaagagctttcaaactttttgtccctgcttgcaccattcctaaactgctttaaccattttccaaaaaattaaaatgaagagaaaaccagtataaaactggggggaaatgtgcattgtacaaacaggttcataaagacttcatgaaccagcaaaatcagaaagaagcagaaatgataccgaagagcatcattttagagtgaagaacaaacctttcggttccaactacaaaatcacatttctacgtctgaaaactagctttggctctgttagataatcaaaaggataaggtgattgttttctacacatagaatgaaaacaaaaggcagattttcctatagatcacaaatgcttctacaggcgcttaaactccaaaggagtggtagccagggaaacagttaggagggtcagcaggtgactccaagaaaggcagagcacttcgttagaccaacatcaaagccagttattggaaaatcacttgttcagtcaacttagagttatctcaatttccttcagaaagttaaataatatctgggaatttttgagccacgtggtatcacattccctatgccccagctcttagcacttctataagcaccaattagagatgaagctggggccaggtgtgcaatcctagaactttggaattactccttgaagccaggagttcaagaccggccttggcaaaatagcaagaccttgtctctacaaaaaaaaataattttaatcggcaggctgtggtgatatgtgcccgtagtcccagctactcagaaagctgaggtgtggaggatcatttgagccgggaagtcaaggctgcagtgagctatgatcaacgtcactacactccagcctgagcaacagcaagaccctgtctcttaaaaaaaaaaaaaaagagagagagagagagagagagcaagagatgaagctggaatttaaacccaggtatgtctgattccaaagcgcttataaaaatagcagcattttaggaaataaagtaggcattaaaaaagaaaagaaaagaaaatagcagcatataaaacaggcctcacagaataggtgggatttggaaatgaagactggctgagatttaaagggaggtggcaggaaaagcaggtgctgagaaggccaccagtggaagggagcagcaagagcaagggcatggcagtgcaaaaccttgggtgtgtgcaggaattaccaggcagtggtacagaaagcacagatgtggagggaggcagcacaagataaggctggaaatgttggcccaggccttctagtagaagtgctatgggctcagtcaagaaggtagactttattctggaggcaatgagtaatcactgagggctttaaagcaggaaaatagcataactgcaggtagacaccaggaacctgtttttcctgtggcatgaaggatggatcaaagaagagtatgaaggtgacttacatatagtagatagttaattaatgctgaatggatgaaggcaaaaacaccaagttaaaaatttattgtgtatctctaacataacaaacccatttgatccaattccatttcatattgttcaatctgctacttagagaacaacttcactcattctagtgggaaataatggtgctggtgcttcaaaataaaaatcaattcaccagtcaaatgtggcccactaaatgttgctcttaaagtctttattcttacagaaattaacattttcttcttctattcagaaggaggtacatctgaacagctgttgcaactgctgaaaaagaaaacaaaattaaccaagtacaaaagttaggcaatgacaagtgatcctccccaccccacccctctccccatctgcaaccatgtgaaaaggttatcggaaaataaggaaattacaagctgtaatggtatatttcctatgctctctcatagtgtctaagtcaaacacatactaagccataaccttcttgatgatgccaaactttcttctgcacaggtcgtggtaccatctgcaaagcatcaactactcagtgagaagccaaggctgaaaaatactgagatgagtcatgacctacctgattttcttcatgggaaaccctcatctgctccttgaggacagacatccgcgctgcctcttctttcctcaagactctctccttcttaagctcaggactccagaaagtcttaatactgttcatggaagatcccaatttgctgtccttgatgtctagctctttccggaggaggtcattctctctctgcagttctttcagctgggcctgaagatctaacattgtgctgtctcttacctgcctcaacatggaggggacctggtggtggtgatgatgggatgagccagtcagcccaccatgttgatctgtgtatgaaaggacatctgtgtgggaaagtccagcagaagcaatattgggactactccccatggctgtgacacggcctccatatacagctcgatttgtagcccttcccagagtcatagtgccctttgggtaggttgttgaagccaccccttcatgatcactcagatacatgggtccagacgtagcataggctgcattgagggactggatattctccatagacagagtcttgcctgttcctccacctcccccactacttgttcttcggtggcccaaacgaggagaccttggcaaacgaggggatctggaagggctaccttccagattggtgattgttcttgcacttccatacatttttcttgtattatgaggtgttactgaagagaagaaatgctatattaagttggggtttgagctaatatttccacgattgtccagaattttcaccgcattcttttcacagtccgtaccagaaaataactccactcagagatctacaaagtgaaaaaaagaataattaaaaacaaatttctttagaactctaactgcattgtatttttaaatatataaagataatgatagatgtacctatgtagataggtgattaataatagacagatagaaagagccacacccataatgttgatttataaagaaaagcaactctagaactttactactacaggtgaaagttttacaaattccccccaccctgcccctaagcaagataaaaattctcaaagtgaaaaataagctctattctttaagaaaatgaagctctctatattggtttgtgctaaggttagagttagaacctctagaaaattccccatggaattgcccatcatggagaccttagctataaaaaggcccctcctttggggcataacccctatatgcatgtgacttgaaagtgactctgagaagctgctgattcctgggatgtcaaatatttggcattcatgttgttaccttcccctcctgtactcattacagacatcactaatccatcacagtcttcttttccactaggttcagaattcttctcaacacaacactctagatggcttaccaccaatcaactggtattaacacatgaattcaaacctactggctatcctggagatagaagaaaaagaggtagctcaaccaatgggatgcctaaacacatagccagatcctcaatgatattaccagagaaaacaacagtcctgtctcttttccctttcacacacatctttcaggctggcctcttgagaattatttcccattttggttgaccttaatattcatattaaccacttcatgtctgtacagaaatggcaaaggagaagaagttcccatcacggttactgaagtatactagtgaagattttatgtagctggggctacagcattgtgagtatcccttcaattttagcacccatatggccttaatggggcacattatggcctcctgttcttcctcttagaaagtctttactgtattttcttttccttcagctttacaacaataaaagaacagatttgagaaaggcaaacaggttcaaatgtccatgctaatactaaccagctgagtaaccttagacaaattatttaacttgttatgagcttccactctgcaatcaacaaaatgcaggtagtaccatctaactcatagtattgtaagaaatagtaagatgaggtttataaaacacctagttttgtgcctagtaccaaatagtcaataaatagattttgaaggtaagtgtctcaatgagataagtacattaatagcagtatacatgggtatcttttattttcacctgcctatcattcatcccttccccctctcccaaatacacactttctgattatactgtcactattttccttagagaaattgttcccaaccccctactcacagttcactgggtttagataaggttgactcccttcactccaccatcctggatggtgcaaggggtgagaacatgacccacgcctggccaaccaccatattgtatcctccagacatggtagctagtttagtgatgggcatgtgacccacattggtccaacaagactccatactaggactctagttggaacagctgggaaagataagctcttcttcagctggaattccttactttcaagatagagctgtgagtacttcaatgtggaaagggcctccctgagggtggagacaatacaaagggaaccacagctaaacttcaaagagtgtgaaaccaaaccaggtgacatcacttcatactccagatccaggaatcatagaagttaccatcatctatcatctatacatctgttccctggccattttagttacatatgccaggtgactgattgcattaaaggtctcaatcctttactcctttttttatatatgtcttggcagtgttttcccaatgtgatgctaggttcagtcatgtgactttatttgtccagtaaggtgataacaaatgtgaagtaagcagacgccttaagcaacacatgtgtttactctcttgctcattttcctctaccatagtaattagaatattcccaatctagcctgatgcaagatgagaaatataaaatagaaccaagttgtcctagccaacaggcaagccgccccaagatgtgtgagcaagcccagccaaagtcagcagaactgcctagccaaccagccactgcccagcggggcatgagcgagcccagctgagatcagctaaacaccacacttatgcacttgataaatgcttcttagtatgtcactgatgttttgtggtggactgttttgccacattacaggatcaatgggtaactgatgcatttgtctataaatttcctttttgctacattcaattctagatgagatttctgtcacagatagtgacacatacagtatgaaaaaatgttttctataaaggtttcccctttccctcaagaggtcttaaaaaattatacacctgtttctaactaaagaacttcatttcaaatgtttatgttgctcagggcttaattttgtttttcttggaaatacacaaaaaccattttgtatctaagatttttacatgaataatctgtagtgtaaaaaagaggggatcaatagttctaacataagaattcggtgacataaatgataagagagacagataatggaatagtggaacaggcagttacatgaatatttaataagacagaaagatgttcatgacatactggtggcagggggagcagacgacaaaacaattttgtgatttactcacactgttgtaaaacacacaaatacacatacaccctttcaccagcaaagaaggctggaatgacacacatcaaagtgttaccagtggtggaattccaagaggttttcattttcttctttttatttgcatactctaaattttctacaattgaaactgactcaattgtcccatagagctgatgtcagtggtttctttgaaaaaacatagaaattgacctcccagttttaaaacttgagaaagttgcatttgtcttatctgagttcctttctaaggaaaccaaccatcaggcctcccagatagtgtcaaggagctcaaactcgccagattactgcatttgggcaatgagatgtcagacccttcatctgtcataattgccttgccctatctgcttccttttaaccaactcctcttccttatccctccctaattcctgtttttccactcatgattacatttcttccctgctatataaacccttacgttagttggtcaaggagatggatttgaaactgatctcccatctcctcagctgcagcacctgattaaaaccttcttctctggcaatacttgtctcagtgattggccttctgtgcagcaagcagcaggacctggactgaacctctggtgttttggtaacataataatgatatatacttttttcattaaaaaaatgattttctttctatggttccaacagttaaatgaatgtatcttttctgtgcttacaatctagatgtctgggttctaactgggccaccacttatagagatgtcttcctagaaaaagtgatgaaatctaacttgtcttcctctgtctgctccctttgtatctagagatacacatttctgaggtctgtggctaggcttgaggtcccggaatgtcataaaatttacacgcacacagatttaatcctcagtgaatttacctgcctacctggccaaggctttggagaatcccaataaccaacaaacaaagttagtttgttccctttggaaacacacacacatataacatacaacatgaaaagatgtattatcatgtttgaaatattgtttccttatttaaaaagtaatatatgttgccactggcccatagatttcttgggttctccttttctaggtttaataacagatgtatgctagtatcatagatagattgagaagctttccatttttcatatgttctggaacagttagcataataccagtcttccctattcctgaaatattttgtagaacacacacataaaactgaatgggcttggcagggaatgttgactcctgctgtaatgctagctactgaggaggctgaggcaggaggattgcttgaggacagaagttcaagaccagtctgggcaatatagcaagactctgtctctaaaaaaaatttttaaattagcccagtgtggtgtcatgtgcctgcagtcccagctacttggggagagtgaagcaggaggatcacttgagcccaggagttcgaggctacagtgagctataactgcaccactgcactccagcctgggtgacagagggagagacccagtctctttaaaaaagcaaaaaacacagaatgggcctagttgtttattatcttttcactttttcactatgtttacttgtctatttgggtttgctacctattttgtgtcaattatcattaaaacgtcccttcacaaacagtctattccgtgtagattttccagtcttattggcattgctttgtataacttttctttaaaattttttaaatgatatagcttttggttttattaatatattttactgcatcttattttccatttcattgatatctctttatctttaataaaatttctacttcctttatggtttttttttgcccttttgcattgaatgttcatttctctttaatcacatttcctaatgaatgcatataagattatacacatggctgcatattccagaattctatgtataaaactcttattggcatttgtaaataccttgctgtttttattttgaaatttttctatcccaggaattattgagaataatatatttaaatgtcaaagtggatagaaattttatggtaaactttctagttcaaattgtatagcattgggatcataaaatgtaacatatatattttccaatctttgaaatttgtcaagactttctaattggcttattagtttttcttaattattaaaccaactaatagattattatagaaaatttagaaaatacaaatatgcataaagcagaaaatgaaaacactctcaatcctgtcactcatagataacctctattaacaagctagcataataccagtcttccctattcctgaaatgtttcgtagaacacacacataaaactgaatgcggccgggcgaggtggctcacgcctgtaatcccagcactttgggaggccgaggcgggtggatcacgaggtcaggagatcgagaccatcctggctaacacggtgaaaccccatctctactaatagtaaagtacaaaaaattagccaggcgtggtggtgggcgcatgtagtcccagctactcgggaggctgaggcaggagaatggcatggacccaggaggcggagcttgcagtgagccaagatcacgccactgaactccagcctgggcaacagtgcaagactctgtctcaaaaaaaaaaaaaaaaaagaatgggcttggcagggcatgttgactcctgctgtaatcccagctactcaggaggctgaggcaggaggattgcttgaggacagcagttcaaaactagccagtatgtattatgttacttccaattccttttaagtgtgtatgtgtgtgtgtgcagttttagacaaagccagacaatataaagactatgtaaatcaaactatataaagactatatataagtcttgtattttcctttttctccatgttttatcttaacatcatctccatttcccacttaacatagatgccacaaagtatttttataacacaagatttttgacagatactatgagcctccaaagatggccatcaaaagtcctctccttcctatacagaattgtctgtagttccattagttccatcaagaaattgattctatttcctttgtccttgaatctggactggccttgtgacctgcttagaccaacaaatgcagtagaggagacactgttccagctctgagtctaaccctaaagaggcttgacagtttctggttttgctctcttaaaactcagctgccatgatgcaaagaagtccaagctatcttgctaaaattaggagccacacagaacggccctggaagatgaaataccacatacagagagaggccacgtgaaggagaaccaaagcacccagccaagagtcagcaccaaaacaccaatccagtgagacaagccatgttggagcttccagcccagcccagccaccgtctttaatcagctgcatgaataacagccatcactatatgtaacaagaccaccaatcaacccactgaatcaggtgggaagtaagaaattattatttaaagccccactccaagttttacagatttttgttacacagcaaaagaactgaaacacttaggtaattatttttaaaatggaaatatcataattaatattgtgattgataaagctttataatattttgattgataaagcttttcaatgttccgtttgagcaatattcagattgataaagctcttacttccctaggataaattctttttgttgttgttgagacagactgttgctctgtctcccagactggagtgcagtggcataatctcggctcactgcaacctccgcctcccgggttcaagtggctaattttggtatatttagtggagacagaatttcaccatgttggctaggctggtctcaaactcctaacctcaagtgatccacacgcctcggcctcccaaagttctgggattaccggcgtgagccaccatccccagccttccctgggataaattttaaaagaattataaaataaaaatgaaacagctggatacagtggcgtgtgcctgtagtcccactgcttgcgaggctaaggcagaaggaaagcttcagcccaggagttcaagtccagcctgggcaacaaagtgagaactcatctctataaaattaattaattagttaatttttaaaaaatcaaaatgaaacaatttatactcacatccttactcttgactctctttccttcacagcttctactctactctcaacatatcccaaaagccaccatctcctcttgaggctacaaaaaaaatcccgaattacgaaactcaggatttcagcactatacattcagtaaatacacctaaagaagtatttttttatttatttttaaggcagagtatcactattgtcacccaggctggagtgcagtggagcgaactcgcctcactgcaatctctgtctcccaggctcaagtgattctcgtgcctcagcctcctgagcagctggaccacaagcgcacaccccctcgcctggcaaatttttgtaatttttgaagaaacggggttttgtcatgttgcccaggcttgatcttcaactcctaagctcaagtgatccacccacctcagcctcccaaagtgctgggattacaggcgtgaaccaccgtgcccagccaagaagtatttattaagtaccaacattgtgctactccagctcggctttagaccagtacttcctgaacagtctgacaaatgttcagataaacaaggctactggggttttcgttttaacccaagatgtctcagagacttttaggacactcatatgtattgggactgtcccaaaattaagtatacaatatagcttttccaaaattgatttgacaaccgaatcctcttcccttcagaatacctgaaaacatttcactgaacacttgaatttactcatgcaataaatactttttaagcatcagcttaactcccactgttgaatgagggggataaggcagtgattgagacagacgcaggttctgactatgggaagtttgctccctggaatggactttctccataagagctttcttcacctcagatataacaggatttgagaggaaggtgattacaggactaggcactgctttaagggcaggtacatgaaatcaaccccaatcagaattgacctctaacaggaaaagatagaagatcaaaataatgactagttgaagtttcagccctactaggccaggaaataaatataattctgtatttatttttcacacctcgacaaagaagccagattgttaaaaggaatacaagtcagccattgacaggctgcagtaagaggctgtggaaacacgttgttgcttacaacaccaagatcacaatgggcaagagattatgttcaattccactgaacttatcaaatcaaacaggaaattcacagaccatcaaaatggtaaaagggtaatgtcttcaccactgtacatctgcttcttaacaataaattttagttagcgacgtaggctcaccactatttgggaattagtttctcccacaaaatttataaagagcaggggtggtttcctgggaccatttcacccccggctgcagcacatagagtgataccaatgtcatggaagaaggaaagaatcagttgacaacataaagcaaaggcaggtccccatggctgtcatgttcccctaagcctcataattcctacttgttctgttgagtcactcgcaccctcccccatgccccacccagctgtgtttcatttcccgatatattttaaggagcttgttttgacacttgggctttttttttttggttgttgtctcctaatttctcatctatcctgatttgtttctaattctataaaataaatctctgagaaagagcaaaaagatcaactttattgagcaatcaataatgcaatcatgtcttccattgcccattactgacttaaaactatttttaagcttttccacccacctataaatgggttttaggaaaaaaggtagcagttaagatcttacagttttaaatacttattatgaagccaagacaggttcagtcattggacttttttgtgaactctttaaaaatacctacaattttttttttttttttttggttgagatggagtctcactgtgtcgcccaggctggagagcagtggcctgatcttggctcactgcaagctccgcctcccgggttcacgccattctcctgactcagcctccccagtagctgggaccaaggcgcccaccaccacacctggctaattttttttttttttttttagttttagtagagacggggtttcaccgtgttagccaggatggtctcgatctcctgacctcgtgatctgctggccttggcttcccaaagtgctgggattacaggcgtgagccaccacgccccgccaatacctgccaatcttatatgtttgtgatgtgcaactgtaagaagggtaaattattaattaggtcaaactgtgtacagaaacaaataaatgttgctgacatcaaaaaaaattataacaccaaaaaaattagttgcgcaacacccttcactttaaaagaaactcatgaataaaattcaaagtccaagggtaagttccgcttatggctcaaacaaaataaaataaaagatggctttatgaacctataagaatgctttctctaattgcataggaattcataaataagatatacagtcatccactcactctcttaaaaggcttaaggactcttgaactataagctcagaagggaaaaagcaggggagaaccttgattcctgtctaactcaagtatctcagactatcatggtctggaacagtctattttaagacaaaagcacttcctgctatctgctctaaattaggttaagtttatttccacagatctccgcctcagcccatcacctgaggcctgctgacagaccgtgtgagctgagatcatcagtatctcccaagattttgccaacttaaaatatccttttttttctaatcagcatccctaacttttccaaaattctgtgtcacagactactaattctaaaaacctttctaaaggaagacacaatggaaaacagatctcaaacaagcagtggccacccaggagccagatgttacctgcagatgtgctgtgtatagctagcacagtgttgtttagaatttctattaatagttgccaacatagaaagatagacagttcatattaaaatccagattctgatgcttccttaaaaatctgaaaatctgacaatgtcaggctcacctttctacatggcaataactggttggagcaaccagcagctgccccttcaagagaggacatgtaccctccagtttgccacagtctcctccactcccattatcttatattcagtctgattcctttcctgcctgcttcccccaataggtatttacattttttaccactctactcacatataaggtcttaaacaattcattcttttacaattcattcttttaccacccacttcaagttctttaccaaatcttattaattctacctccaaaattgctcttgaatcttctccgttgtttccactcctcttgaaccaatgtgactcttgcataagctacttcatacctcctaaagcttctcctcttatcgtcctctactcttatttccaaaatatcagctaaactgttttaagatacaattacgattataaaatatctccccttacccacttaaaacccttttaaagcttcctattgctctgtggacaaaaccaaaacgcttcccatggcctgaggccctgcaggatctgagtacagccaacagcccccgcctcccctcttgccactctctccttcaaagactctgacagggtcttcttcctgctgctccaatgcatcaagtcccttcctgtctcagagccttcactcctgctgttctctttgcagggctaattcctattatttcctattccatcacttacatgatagtttcaatagcataccctctacaagatctatcccattcaaatcaggtctctcagttacattctctcaaagcgtaatgctttttttttttcatgatgtgaaagacatgctatcttttttctttttataagagaagctgactggccaagggtcatctcaatggccctcttgtttaggttaaagtagagttagactaggtagcctgaatcctctggtgaaggtgtaaggaaacccttcataacccaactgaggctgtccctcctcagatccctggtttggaaaatgtgaaatcttgtaggtgtctttatgcacaatgatccgggaacattcacggagggaagtcactgacaccccagtcttaggtgcccaggattcagagtaagtgagatctatgggaaggaattagcatagctccaccagacttagagttcccagaaattaaataattacttcaagatagaagtccaggctggtgattgggactcaggacatgtgacccagtagccatggagaagcccctattgacaaagtgtgtgggtaaggctagaagcttctggagacctcgcatgctgtatggagcctgtacagtggggcacaaaactgtgcacagggttgtaactcatgaggaaggctatatgtcctagttggggttccccaccggcagatgctgagacaaggatgtgggtgtaggaggttcatttataaggtattcccagaaagtactgagaggacaatttggaactaaaacaaggaagtcaaggaagtcaatagagggcgcattttcttctttttttttttttctttcttttttttttttttgagacggggtctccctctgactcccagactggagggcactggcacaatctcggctcactgcaccctccaactcccaggttcacgccattctcctgcctcagcctcccgagtagctgggattacaggcgcgcatcaccacacccggctaatttttgtattttggggtagggacagagtttcaccatgttagccaggctggtctcgaactcctgacctcaagtgatcctccggcctcagcctcccaaagtgctgggattacaggcgtgagccaccacacccggccgagagtgcattttcaagaaggtttctgctgcaagcaactggaaagagcttcgagaaacagtggagaaccggcctcataggtgcgcctccggaagggcaagaaactccatcatgggctgagggatgctccctggcactcccaagtgaagccaaagagaaagccctcatgttcccatacaggccatgagtgctgaggagatgcgggtggggcaccaatagcatccgctacacccccacatggcacactgtgtctgagcttggccacgggggactgggttggccttcccttgcaggaccacagagtggggaccacagagggcacgcacagcatctttcagtccgagggagaacagcctcaacagcgacaccttgtggcatcaagatgtaatcatgtgatgggctggtcggacagattgatttccagatttggatgtgggatttatatccatatcccgctcgctctggggctgtgtaagcccgaagcagcggggaggagaggaaagagagggagacgagaagtggggaaggttgggaaggcggtctagtggagagattcggaacttccagctaaactggcacatgggttccagcattttggatttaatttggacaaatgaaactgggagcaagggttgtttatttgcaatatattgtaatatactaatcttagtatatctgttacaatatttataaaatatagagattatattatttacatttaatatttaattttaatatattctcttttcatttatttttataaactttattaaagcagaacatatacatgatgaaggtagaccttaattgcacacgttaattgatttttttttttgagacagagtctcgctctgccacccaggctggagtgcagtggtgtgatctcggctcactgcaacctctgcctcctgagttcaagcgattctcctgcctcagcctctcgagtagctgcgattacaggtgcccaccaccaagcccagggaatttttgtatttttagtacagatggggctttgacattttgttcaggctggtctcgaactcctgacctcaagtgatccacccgcctcggcctcccaaagtgctaggattacaggtgtgagccactatgcccagcctgcaccggttaatttttatatagtgagcacacctgtgttaccactgtctagaccaagacttagaacattatcagcatccccaaagcctctctcatgtccagtaatccgtatatgacccaaaagcacttccataccttagaatttcatattaatatgtgcaattccttgttggggtctctcttccctcctattataaacccctacactgcaacccaggtttttacattggtgctaacactcttagagcccatggcaagagtacaaatggatgcccagataccatgtgcctatacatttaaagttataaactgagctaacaaactggtaaacaaaatacattctaccttcctaccttgaatacagagatggggaaggtgagatctgaattttgaacttagaatacttagactcctcagaattccaccaaaacattgtggccggaggaaggcctgccccccacacctccgccaacaccctttctccccacctctggcccaaccataccccacgggcctcatacacatgaactctgcagcatgcaagctaggcttgctccagctataccaggggtccacaggctttctctgtaaaaggccaaacagtacacattttaggttttgtgggccacttgatctctgtcataactactcaactctgccatttcagcccaaaagcagccgtagacaatttgaaaccaaataggcatggctgtgttccagtaaaattttatttataaaaacaagtggtagttggccgggcgcggtggctcacacctgtaattccagcactttgggaggccaaggcaggtggatcacaaggtcaggagatcgagaccatcctgattaacacggtgaaaccccatctctacaaaaaatacaaaacattagccaggcgtggtggcaggcgcctgtagtcccagctactcgggaggctgaggcaggagaatggcgtgaacccaggaggcagagcttgcagtcagccgagattgtgccactgcactccagcctgggcaacagagcgagactccatctcaaaaaaaaaaaaaaaaaagtggtagttggatttggcccacaggtagtagtttgctgacacctgatctgtaacgtcacacatatgtgcccctccacaaccctaagcctaggatgtgcacagtggtagcctggcttacccccaagaagatgtactaggaaaaaatttccaggcagattctggaagacaactcagggtcatttaggcaaggaggtcacaggcctgtaggtacccagagcggactctagaatgccaggcacaggctccaggtgggcacctgcattggtcccttggactcttcctccagtggacggtgcagtcagaggagaaccagagtaggccctctcgcccaagagtaagggaacacgggagctatgcaaaacaactttgaaataattgaaaggatgatgctggcactttaatatcatgacattttcatcatatcactaaaatcacttccatggcagttataggacaattctgtaattgtagccagagaggagagacatagtgttttaaaaaggaaaagaggagcctcaaaatcagatttggctggagtcatatttctgtcttctggatacgcaatcttgaacaaagtattttacttctctcatcctcacttttctcatctgtaaaatggggatatcagacttttcgtatagatttgggaaagattaaatgagatgatataagaaagtacttagcacaatacctagcacacagctaatgatcaacagaagttaaccttgacaagcccaaagctaccagaatataacacagtggctttcagcctcaaagttgccatagaattctcccagttcactaaacttagccctgtcagacactttggagtcaaactcaatctgctgttcaaaagtgctgaagacatcaaccccagttctctaaaactagagagaaaaatggacattgccttcccccatgatctgcaggctacaatattatgcatccatagttattcaaagtcccagtaataaaccatttcatctgtgaatgccatgatgtgaatcagtaaggggaaagtccagcttaatacagcagagattttcaaaattgctttcccatcattctccaaaaagctctatgaaactcaaacacgcctatccacacatcagtactctctcctttagttcccccaaactcattttataattactgttttccatgtgtagatttagcatgattacatgttcagctgccttggctcatgttttatggcaaggtacttgagtcaagaggctgactgtcttccatactacaaggcaagggctctgcatgcccaaatattagttaactgttctttccattaaccatttccattatttaaatttcagactccatcaatttatttcaaagtgttaaattaaggatctgaaacccctaaaaattttgttaaagtaataaactattatctagtacacagctaaatccacaagttaaaaatatagcaaaacagccaggtgtggtaagctcatgcctataatctcagcattttgggagaccaaggtgggaggatcacttcaggccaggagtttgagaccagcctgggcaacatgacgacaccccatctctacaaaaaattcaaaaataaattagtcaggtgtggtggtgtgcagttgtagtcctagctacttgggaggctgaggcaggagagtagcttgagtccaggagttcaaggcagcagggagctatgatcacgccgttgcgctccagcctgggtgacacagagagaccttatctctaaaaaaataaataaattttaaaaatggcaaaatcccaaacaataaacagtaaaattaagaaataatttgagatgttaaataaaattaaaataagtgacgtttaataaaatatgctgattataacaacattattcatcgccccataaagtctcataaatagaacaaattaagtagttgcactgaaagaataaataaggttttcagattcgttttttaaacatctatgcatttcctttcatctgcaaatgtaaaatgtcaattggcaaagcttcagttatagtatacttaaaaaaagaatattcaggaattattgggtcttacactaaaaaatcttctatctgtcaactaacagacgtttctgagaaaatgatagagagatagaataaaaactctgcccccttggccctaaaaatccaatcacacaaaattttgctacatttataatggcataaggattacgtgtaaatagctttttactagaaaagaatataggcataatcacatacgtgaggaaaaattttagcaaagattgtaagctattaaaaaaaaaagaccacaatcaatgagggatgaggaatggctccaatgggcaaattatggagacaagcattcatctatgtattctggaaagaagagaaagaataaacgttacatcctaaatctgaggtctctcaaaaatatgactgataaccatgaaagagtcacattggaggctttaacaaggatcaagttcagggtgctgaatggtatacagaaacccccttaacaatggaaattagagtaaatgagagtcagtaagtgcagtaagtaaatcaagtaattgagtcaaatctcttgtctatgaatggataatggtaggcttatctaacataaaaataaataaaaagggaaattacaggacataattcggatctattcaacaaatacttctggagaacaaatctgtaatgtggtttctgacatgatagaggtccaaagccttccatttaaaagggggtcacagcctctttactcaggttcacattaacaactctaattgttgtgcaaggctgccagttgctgtgaacaccagaaacagatgagggcctttctgggagtgatagagtgtggtctcagatggagagagtcctatggaaaaaagagtgtagtaacagacagggaaaatccagttttttaacctggacaagaactaaggagggaagtcagatccatagttatgcatattaaagaatctgcaaatctcatgagaatttaaggcttgtttttatttcagaaatctgaaaacaaataatgtaaggatattcttgatcagcacagcaccatgcccattgactttgaatatcaagctgtaccctaaggaatcactgagtcaatgtgaaaggaaataagatggtcttggggatctaaaggatgtgttctcactgggtgaaaggtaaggattgtcaagttcctcagaaagaatgaaagtttcacagaagttgactatgatgaatatggtgggaaaattgaatcatcacccagtgcacagcagggtagaccagatgatgccaaagaacctgtccagaatagtcagcatcacattctaattataagcagcaatttagttaatgcagttaaattaatgttatgaatttgaattagtaatgtcatatgacatatactctatttctaaattgatttaggttttaaaaaggtgtaagagctttaaaataaaactcaccagctttatgtttatacaatttaaagtatcattacataataataatttaagccaaccctggggttctacgagaaattattttcattaaaaaagatatcatctaagtctgagaaaccttggttaagtgattaagcatacactggatttgagacctgaatctcacatttattatctgtttaaccttgagcaagttagcaaacctctctgagcctcagtaagtatctgagtaacaatggcctcaagtgtaacaatggctacttcacaaaaataaggtgaataatgattaaatcagagaaggcagaagtacttagcacagtgcctgaggcttagtaaatactcagtacaatcctcatcatcatcaatattgaccacaggctcattgtgttgttttcttacattagaccctttcttcctcatgagtaaaatagaaataacagcgttaaacatcttgcaatgggtctaaaaaaagtagttgattaaaaaggttgccaaaaaaaaactttgcacatgcaagtaaaactttagcccatgcattaaattgcatcatgtgttcaacatattcaccatccccctagcctgcccatccctacagtctccttcctgtgggaagataatctttcctgctccaatgacatctggcttggccgtatgacttgttttggccaatgaaatgtgagcagaagtaacaaatgccataaccaaacagtagctatcagagccctcttgtgggtaaaacattcttttttcttctctaccatgaagataggctgtccaagaaaggctccttcagcctgtgtcccagaataaagataacatggagcagaatcacagacaacccctgagagaaagaagccactgagatttggaggtcctttgttagcccagcacaacctagcaatatctgactaataaacccagctaccacaaacacagtgctaaaaccaaatatgtaacatttagattaaaatataggacagtgctttctcactgatttatctctcatttctctcttcctctgcagattaccaaactaggaaatatcatccattccatgacagaatatcttctgttaggtctccagatagatgcaaatcatttgtaaataatttattttcagatacagatgcatacaaccaactattttaattgcctccaaatgtattctctttatcattcctgaccactgatttctttactgacaaatagctgctcctggtgcttggacatcgagatgaaggcaatcactggaaaagccgaaaggaggataaatcctgctaggaggtgacatagttgtacaaacaatccaaatagtgaatgccagcgagcatcaatgggcgtgggctggacctcgtatgatcagtacacatgtgagtgcctgtcctggagcacagccctaggaagaatccagctgtaactgacccaagcatgcctccacaccaaaagaaaggcaacacatgcacccacctcctgctatcgtgattccatcttataatggctgtgtgacttacagattgcaccaactgatgaccctgtcttcacttgaaccttttgcaaaacagatgattcaaccctgtaccttccttaaaggcaagaactatgtcttcttcatcttcatatctcagcactagtttacacttgcaattaaaaggcaactcaatgtagagcagtttaaagcatgggctctgaagagtccaaattccagtttctccacttacttaggttaagatcttgcaagcagatgctctaagtgcctatcgatgtccctctgacctgaacattttagagtgccccaaaggcactgccaatatcagaatctctgcctgagagtatcttttaaacctggataagctagtcttcccttgcagggtgtagaagtcccagggttaaccacccttaaaaaaaaatctgacagctatttatacaacagtgttcacaaccgcattattcatgatagccaaaaggtgaaaacaaccgaaatgtccactgatgttgaatgcataaagaaaatgaagtatacacataaaatggaatattattcatccttaaaaaagaaatgaggaggccaaggtgggtggattatatgaggccaggagttcaagaccagcatggccaacatggcaaaaccccatctttactaaaaaatacaaaaattagccgggcatgttggcatgcacctgtagtcctagctacttgggaggctgaggcacgaggatcacgtgaacccgggaggcagaggttgagaggttgcagcgagccaagactctgtcactgcactcccacttgggcaacagagtgagactctgtctcagaaaaaaaaaaaaaaaaaaaggaaatgaaattctgatacgtgctacaacatgaactttgaaaacattatgctaagtgaaataaaccagccacaaaagctcaaatattgtctgatatcatttatatgaggtacctagaatagtcaaattcatagagacagaaagtataatggtggtttccaggggctgggggaatgtggagttattgtttaattagtacctagtttcagtatgggatgatgagaaagctctggagattgatggtggtgatggctgtacaacattgcaaatatacttagtacaccaaactgtgcactttaaaatggttacaatggtaaattttatgttatgtatattttaccacagtaaaaaaataaaaataattaaaataaatttaaaaaaaagaaaagaaaaaaaaacaactgacatgaactagtggtgagacatccctactctcctagcctttgtgtaaaaataccctaaggcaggtgttttacactatctctacaatttccttatgggattaaacactagttgccattgcacaactcgcttaacaatgcaccatctattggctgccttcacttccctgtctcatatcctcattcactcactagtgaccccctgtaagtcccaagtaactatttgtctcagggtctgcttctgtgggaaagtcaactaagacaccaaggcaagtttcttaatttctctaaacattactttccttatcaataaaaataatacttagatcatgaagttattgtgaagattaaacgagataattcttcaaagtacttagcacagtgcctgactcatagtagatacttaatatgatcttcttgaatttctggtctaacaattatccaccttttttatagaagataaactacgtctctcagtttcaggaagagactaaaaaaatctaagagccaattctttcccatcttctatttaaataacatctctcatgacttagcactcatcattcaaccaaccacaagaggtattagaaagaactggaattttgtatccagctcaatcttttgcctagaggtgggctgagcccacaaaaaaagttagataagctccccagatagcaagaagacccccccaggacagacagataaccaccactccctcctgacctagggaattagagggctgtggggtcaattgtaaacaactttgatctggtaaattttatgcgtatccctttctctctttggttacaaatgtaccctcctaaggtttatggcaaagactagaattcatttagtctttttctagttccacagtgcatcattttaacaaatgaaaccatgggatcatgaaattcccagtgaggtgaatcctttgccaaatgccattttattttgctttgatttctcgttacttgtttgccaaaatacacagagattttatcacaataatcacctattctgactagcaaaccaaaggattaggttacatactctggtggactcataaataagactgatgagaaatccaatttctgtctcttgcttttgtagaaaacacctttctgaatatgtactttttaaaaagctgaacaaacaaaacttaccttgacttacatgttaaaaagggaagctctgttccccaaaacaaataaatgataaaatcccaaattccatcttgctctttaatataatccctaaagcttttttccaacatttcatacatacatagcctttaacttcactcacaactataaatagttggccaatttaagttcaaagcatctgactaaagctaaccactagccatattgggcatgcctaatggtttcaatgtttggctcaattacattatgagctaaatagttctccctgtattattgcctacagttttccattttccacttataaattaatgacaaaattcaagaaatattcaggtgattgcacaaactgttgtacaaatatggtgatgctgatgaactaaaactacttgtcggcaggtaaggtcatggtacagtagctcagaatggtggttcataagctacagcacagaagattaatgtatgaaaggcaatttaacagtgctactgtataatgtacaaaagtgtaaatcatatcgaagtaaagtaagaggcagacactatgcacgggatattgaatagtgttctagcccataactcccaatcttgtacatttcaaggaataatgaaactatttccattcatgaactttctcagacccctttcagaagctgtacactatgaattacttcaagtatttccctcgattaatctaacaaagtcagtttcattctgcccattaagtacaaagattttgaaacacaatgtgtactctctgtgctctgcttaaaatttattgaaatgaactttgtcctaggtgatattgggagagagtctcaaaaccaacaagtgatgtggagtcccactgcagatctttcaccagcagatatttttcctcacctggaaaatggtctttcaaaattattaaggctgtataaattgtgtttggtcaatgaatcagaatggacattgctaggagtcccaaagccataataatcaatctttctattgttcttcaggtcatcttgccaccctctcttcccaatgtcaagtcccacactcccacaagcatcaaaagtaggtaattattgccatgacggtgaaataaaaggagaataaagagaattcagagtccttgatcgtatccgtcccctacttgaaatctcttgaagttttaagcttgagtcccatctcctcaatggctcacagggtcttatgccctgtcacactctctggctcctctcaccatccctcatcctgagccaagctaaactccagctctacagttctacctacatttacctccgtgaaccctgaatctcccattctctcgcttacctttggacctagtgcatgctattccccctgttatttgtaccttcaaatcctccctcctctggctaattccatttacccttcagtgacactttaggtgctactttcttcaggaagccttccttcattcttcatccatgactctcctaagtcttccatgatagcctggatgttcccccaaagagcatccattattgcctgcttacttgtttggtgctccactggatactacaatccctgaactcccctacaaaattacctgctctattatggtcctcttgacgtgtacacaccctattcccagaagaagactggcacaaagcaagcatacacttttacgacgactacataacagaatggcttaattctttgttactaatgtctattatgaaagaacaccagccactcctgttttccaggttaaaataactaataaaatgataattacttagttgaacctttgcatgaagaaactgttgtaaaaatatatatataatagatctagaagagtgcctttgaagcaaattggactagatgatagagaaacagagatcccaaataaggagaaagctagtggcaaagccagaaagggaacttagggcttgtgaccccaggtcagtgctatgtctctgtatccaaaagaatctgctctgaagttattctaagcaactattcatgttgtgaattcaaggtggcccatgaatgcattcaaagcccatgtataaaaagagagttatttctcagctttaacaaaaaaggtgaagaattccccttgcgtgcccacactaactgctccacgctcacaagcctgatgaacagcagccactaagacccaggtgcttttgtatccacccagcatcaaacaggacctattttcaacaagcccatacgaatgccacgctgttatcccactcactacccaacctcctgcttcctgtcagggagaggcttcatgaacaatacgaataaagggtcaaaatgcgaaacaaagaagggggaggagggaatgttacagccttagaagggaaggaaaaacatacatcaccagaaggaaagaaaagacatcaaaaatcctctcctgagatgtcaatgtaaaaaaagagtcaacaaccctgctcctctcggaacccgccccttgaaccacgactgctcctcgaggtgatgacagctggagctggctgacaaaacggagcatggctaatctgcctcaagccaggcacaagaaagacatcttggtagaaatttgatgcccaccagtatcactgagaaaataaccagtgatcatgggaccgccctaacctcacatctggcagagctgctcaactctcactgccagagcagctcccagaccccaaacccaccttcaatcacctcaggcccatagaggatgaactcctgaccacacctatcttattatagagaaatatgccacataagaactggtaaccacagtgcacaactaggttcaatttcttataggaaaccctgctctttcttactgcaattagtcataccatttagcagaaatctttcacggtttgcataaggatctgagcatattcttaaagaacagtcacattgctcaattcccattcaagctcttgtcttctgacccactaagaagttgccttgaattaatagtttgctcctaatgcatttagggtaaatgcactttgctgcctgcaactcattcatgccctgaaatcacagaatgacaactacctttaggggtggaaagtattaagacaggaaaagagagctaatgctatcagaccacacacacacacacacacacacacacactcacacaggataattaagtgagcaaaatgtagactctgaaaaataaaccatagcaaaactaagttgctggtataagatgtctatgaacattgcggctggcctttggttttcaggtatatctcacagatgcccttccaactcttcatccagtggggctataatctcaccattgacttccaggaaaaaataaccacttagttccttcctgaaggttcttcctgcctttatttattttcttctcttcttccatgcacacgcactctctctctttttaattttgttgagtgctgattaggtgccagcaactagagattcctgggctctgaccaagcgaactctgcttggcagagtcaacatgagttcaagaacagaggaaatgcaacttcaaagcaacaaatctggaagatgtaagtggagaagtaatgcccaagaggttaagagcagaactttgaggcacgccctgggaattggccagccaagtgctgaagaaattaggctggagtagcagatgaactggcccaagagaagggtaaccaattatattaacaattaagtcagtgatgtagtggccttggacttccccagctgaaagaatgagcagaaaatcacaaagaaggctcggccctggctgtgaaagtgagacagcttagagctcctggtgcttttggcattgacaatggttaaggcttgttggttgtttctgttgtaattgtggggccactcattgtttctactttctctagtgataatttagcagccttgagagtaaggcagaggtggattcaaactctggctctgccacagcattaactctgagcaagtttttctgttccttcagtcatttgacaaatacttacagaacatctaggcactagggatacagccaaaggcaaagctcctgcctttatggaacttatcaaattatttgagtctcagtttcctcacctataaaatgggataatacatttacctgtataggtaatatgaaatgagcaatataaagcacctagcacagtgcctaccacatagtaaatgctcaataaatggtgctcttcatataacagagcaaacgtatccatcacttccaactggagtattagctccaagtagtaaggaactatctgttgttcatctctgtacccccagtgcctaacacaaagtagatactcaataaatacttcacaaatcaatcactacttaataacagccattgttatggtaacttatagtcattattcctctctaagccacagagattctatacttgaaaaagcaacatggcggcctagcgtggtggctcacgcctgtaatcctagcactttgggaggccgaggcgggcggatcacggggtcacgagatcaagaccatcctggctaacacggtgaaaccccgtctctactaaaaatacaaaaaaaaaaaaaaaaagcaagatggcataaaggctttttttttttttttaaagaacagtgaggtgcactatacaatatgtcttcaggaactttttaagcatgaaaacaaatgttattgagcataaagctttcaattcaaagaatctattagcacagagaccagcacggacagcggatgtagatgccagcccactcttttcctaactacaaagtaaggacaagctggccaggcttcaggttaatccagaaggcacccaaaaagtaagttacataaagtttagcagatgtgctcaaagatggtgtatcagtaaagataagcagaaaagtgctgcagaaaccaaaaatcacaaaactcttcatggcttaaaacaaccaaagtttacttcttggtctatatgtccaactccagttgacgggaagctgtgttcatttagtgactgaaaggcccaggcagatgaagggctccatctcaacacacatttccgtaatcattgcagtagaagagggcactgggtgctctcacactggaaatcaaatattctagcatggaagtgatgcaagccacctccaacatatgcctggaaggaaagaaaaagtggctatggggaacattaacagtctctaccacagatgatattaagacacaacctgtggaataacaaagggatttgttaaagatgatgcacaaataaaacatctgaacagctataagattcacataatcatgaaccaggaagggtgtgtaggtgtcattttagagcagtggcctcaacataaagacacttcatacaacataaatctggaccctaaatttccagaacagctctgctttctataaatatactgagggtccagataaatttttatttaggaaacaaagttttaacagctgaaaaacatttgaaaactatgaatgtaaaccaaatcctttattttacaaatttaaaaagtaaagagaagaaaaaaaggagacacagacagttaaagtaaccccaatctacccctcaaggaaggtctagaatgtttagcagaaataagtccatggacagaatctaatgtaccactgcagcaccttctgaccttacccttcatctctgctacctttaactggcacagtggagccagacccagaccaaagtcatttaatacaaggtcgtcaagggctcaataaatggtattgacaatgagtagaagaccccaccccacagcatgaaatagtgattcatatctcattagcaattctctacattactcattccctacttctgggcaaatgtgaagccatcagtagaagtgaatactagccttcaggagactttcattttgctctcagatgatcataggttaacagcaactatgatttgggttcactcaattccattatcttctcatgtccccagctctgtttcatgcccagttttccctccaccttcactcgtactaaagcatgtatgtcatgcactcaagcctcagtggtctcccaacctctggtctctgtctttttcaatggctttatactcactagcccatgaaatcaaactcaaatatttcaaccaggaatccagatgcctcctaaatcttaatccagcctaattttccaacattatctccactatggtacttgtcctgcacagccagaggcaagatgatgatcctgaaagtcaaaatgatgttgttttgaacccccaatgcttctacttactggttgggcaagtccttaacccctctaagttttaatgttctcacctgcaaaataggtgatagcacctactttgagggttttcttgagaaggtatgtatcagtgaggagtatgtgcggctgcaagtaataagtagtggcttacaagtaaagagctttttagttttatgcaataagaactacaggggaaggcagtctaagctggtactatgaatgaacgatgtcaccaagaccaagatccttccaggctccagctttgccatttgtaagacacgattttggctgggcatggtggctcacacctctaatcccagcactttgggaggccaaggcaggcagatcacttgagctcgggagttcaagaccagcctgggcaacatggggaaatctcatctttacaaaagtatacaaaaatcagccaggcatggtagtgcgcacctgtagttccagctactgggaagactgaggtgggagaatcacttgagccggggaagtcaaggctgcagtgagctgagatcggtgccactgcactccagcctgggtgacagagtgaggccctgtctcaaaagcaaacaaaaaaaaacaaaaaccatggctttatcttcattgttgtagttggctgctgcccctccaggcattgcaccaatgatctcagcagcaagaagttaaagagctgaaaagttcttggagtataccacccacgtgtgtctcactcactacattttcaggaaagcctccacccaaaaacttccacctatgccattatcagacccaactctcatggccactctaagtccaagggagtcttgggaaggtgaggtgggcttatttccatctcagacaaaattggggttcttttagttggaaaggagaaaatgaatgttgggtaggcaaccagcaagcctacccaatattaaatatcttatggaaagtgctaagcacagtgcctaacacatagttaactgcccaatagaagttaagctataaatactagtgttataattattattgttgttgtaattcacctttcttactctctggccaagtggaataactcattatatccatgtgtgcccctacatttttatggtatccattgctctatctgcatctccaactctctccctgctttaaggtccaggaaaatgccattgcatccaagaagtccttccttacacctattcctaatgataagtttcatggtggcaggacccacatcagaataaaactgtgttcaccactgcactgaacattgtctcttggaacacagtaggttctaataaatagtgccttaataatttaagtaattcatgtgtatacacaaacctgttttatagccagccctctaaaatcaaacagagaatattcctgaaatgcagaagttaaggaccaggtttatatgtcacgcagctagcaatgggagtgaggggatgaaaattgcattccccaagaaaaagaaaaaattagaaaatcctctaaccataatttttacatgctgttggaagctggatgatagttcatcaaatattcgctcccttactgtgaacagagtctacgtttacagacaagtgttgtccaaaatagtacttttccaaaacaggttattagtgaaagtgacatttgctcgtgtagtttgcctcttggctccagtgatctgccaggagaaaagcatgccccaggtagctgccatcccttcagcctgggccccaggacacatgtggaggagactggaacccaacccacagcctctacacagccaccccaaggagcccaacctataccagccaaatcacggtcaacctgaagacccatgagtgtgaaaataaatacctgttgctgtaagtcagggagttttgttacactgccaaagctgactaatatatcttatcatttgatatatgttagcatgtcttatatcttcattcattttgttccttttcttcacataagaagaagaggttgtagagtctccatgttttgtacatccagtgagttctacctttggatcaactattttaaatttatgagatctacattaccatgaatattggtgcttttctgtgctttccattcatcctatctttctaaactaagaaaatcacaataaaatataaaggaatagtgtaaacattgctgaaactgaaactgttggctggcaagtagatgccccacggaccagccaaaatgttaactggttagaggattttaaaaaaagaaaaaagaaaaaaaaaaaggctagagggtgtcctagtaaaacaagcaaatgcagattgtacaaaagtcaacctaaccaaagtcaaagactctttaggtaaatttgtggactgcaataccattcaccttatttttcaggatacctgttttggcaaaccttcaccactgagtttcaccaatgggaagagactgataaggcttacatcttgtagcttttccaacataacaaaacaagaggggccggtcatggtggttcacacctgtaatgccagcactttgggaggccaaggcaggaggatcacctgaggtcaggagttcaagaccagcctggccaacatggtgaaacccagtctgtactaaaaatacaaaaattagagaggcatggtggcgggcacctgtaatcccagctacttgggaggctgaggcaggagaatcacttgaacccgggaggcagagattgcagtgagccaagatcacgccactgcactccagcctggtgacagagcaagactccatttcaaaaaacaataaaaaataaaataaaacaagacggtcatgctattacaaaagaataattttaaatatcattatacctaatcactaatggaaaagggtctctgtaaataacaaagaaaataaaaccctaatcccttggtggggagacaactgaaggatgttaagagcatttattcaaccaagatctatttaaaactctaattggaaatttaaggtgtcaagaaaaatggaagagtgtgaattttgttttgttttaccttcttttaagtcatcatcattaagtttggaaccaaatttttatcgagccaaaatttttattttattatgtgttatattttttatattttattatgtttctactggaaatatataataaacagagttactaaatttgcctattggcccatgccacagccttcaaatgcaaaggcaaaacaggctgataaaaggactgtcagaatcacagtggactcttaaaatggttagctctacgtatgctgggagaacccacacttcagactggacacatgcagactacacaaccaaaatttgaagtcaaggccacggccaaggtcatgggctctgggtaagacgaacccgggctcaggttcttgctttcatactaaactgtggcaagatactgaattccttctagttactcatctataatttgggcgtaagaatagtacctacctcacaggggctccacaaggtttaaaaaagataatgcatataaagtactcaacaaagtgcttgcctatgcaataacaatgatgatgatagtaatagtaataatactgctttgacaaacccggcttctacatgaaaaccattctaatcagtatattctggctcacagtctgtttatgaaaggcttaattcacagaattatgttcacatccaggtacaacttctataaagtgacagctctttggatcaatcagtaatttttctaatgaattcagggagaagggtgttgaaaaatcaggctttcactagtagtgagttgagatggatctggtccttcacccatgattcatccacccgtgaaagtcttgctggtgaaaaccatgacaccatcaccttccacacccctccctgccaaaactgtaaaagtattttattaaagcacagaagcaaacagacaagatggcttacatgagaaaaaggcaaactctactactccccggaaagaaaatggcttgaccccaccaccaccgaactgacattctgcaaaagagaacaaggcagccctcacttccagaagttgagttaactgtcagaactaaaagaatcccttctattcatgtgactccccataaagaacgtttgccggctccaaaaataccttataaatccatccagtagagccaagccccaagtactgtatactgagaaacaatgtgactttacaaggacaagagtgaccataggagacaaagtgccacacccttttcccggatagctcaacggtacatgttgtctcttataaagactgcaattctggagaaataggtgggcaattctaacaccccctcccccaattccttctttacacagattcattttcatttttaagccagtggcctcggcatccgcaactactacaactaataatcaggggggtggtgggtaagggatggggaggacaaggaaacacaggtcaaatatacttgcttctaaaagtccattttcaaagagttttcttcccgcttgtctgcctctcacagctgtatccccataccaggtggaaaccaatggttaagtaaaatcactgatttaaagagccaaccaggaaactaaccatgacaagtgggagctgccctcctctcccgagcattgattggttctttgggttccaccggtccccattctacccacgtaagtggcaggtgtggctgtcaatcacagagggaaccgacaattcaccgctcggggagtaaattgcctttcatacagcaaaggcaggtagccgcctaaaatcgatccactcctaaaagagcggaccctccctctctggcaaggagaacagagacccttaagtacaaaataaataaggcagggccgaacggagagtttacgagcgctattttattaccccgaaccaaagcagctcttaatcttcactgtcctaagacgatctttcaaaggctcgtacggtattttttttaattaggtacaccttcgtaagtatccctttttttgtataattaggagatggggaggaggagagaagggatgccgttcagttcaatttcacatcgtattccttttcatacaccatcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagcaggagcgggaggcggaggaagaggaggagaagcggggcggggaacagggagggaggaaagaagggaaggaggaggacactgctcggagggccagggccaggcgcggggccgggcggggccggcggccgagggggcggcacccgccgcagtcccgagacgcgcgctcgcgcggcgctgccaggcgctgcgctcggcggggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccgcggcgcgaagcacctgtccccaatcttccatccccgacgccccttcccgggtacccccctccaaaagctgccaggcacactgggaacttgtcaggtggctttggtgacaggggcagggatggcacttatcttttaagttaagcattggagtaaggggtcgtggttaccataccctggcaccgtccatcagctttaatgttccttaggaggttgaaagaatttcataagatcttcactttattgttcccccaaagaaaggacagaatgaaagataaagacaggaacaagagaaaagatcgcatccgtcatattcactgggtgcctcttctgtgccctgaaatgtgcttgcattgtcccaatttaaggtagaaagatgatgtctgagttgatacgcgcgcacacaggcagatacacacacacacctcaaggtaatgagcaagaggatttggacaagtttttcattggaaaaagcttccactcaacaagtctggagccccagctgctgccattttatattagggagggtactgggatagccatgggcatctttaaacttggtctctttcactgagtagtcaatttgcagggatagagcagtcatttccttcctgtcctgatgagtctgcttccagcaatttcagtggccagatctaaatttctcctgctgggaagctcagacaaataaagcaaatccagccatgggatgtttgggtgcgcagaggcatagaattagtacagcgattagaggatggatccttctttcctccccgataggaattcaatttttttttttttttttttggagacagagtcttgctctttctcccaggctggagtgcagtggtgccatctcagctcactgcaacctctgcctcctgggttcaagcaattccctgcttcagccacctgagcagctgggattacaggagtccatcaccacgcccagctaatttttgtatttttagtacagacgggatttcaccatcttggccaggctggtcttgaactcctgacctcaaatgatccgctgacctcaagcttctcaaagtgctggcgttacaggcgtgagccaccgcgccccgccggaattcaaatattaaatgattcctgctcagggaatcagactctgagagacaaggatgccttcctgttccagcccaaatgcctgttccttaagcctgtacacctctggtagctaaggtttttcatagactctctttgccctcatcctcttctttctctctctgagaaatcaacactcattctcctgacctagatgctccaggggcaaaaccaagctccacctattgtgttttgttccccacatacatccttgacagcctctgctcaaaaggcttgttgtatatgagagccttgttgagagtcctttgagaattcctaaaatcccacatcttttgaaacgtggccaacattttttagtacccccctctgtgcaggcacttacattttctcaactattctcacaaatattctataagatgtttaccaactttcagaaaagttgggtaacataccagggtgatcccatgaagaatttatttaaatcaatgcctgaggttcactctggttggccacccattctcttttcctttgatccgtgggttttaaaaggaacccttgacattcaggggatcaatttattatgtacatgcttatgtacatttttcccacagagagaagattcatggttctcaacagatttctttcaaattgggtccttgacccagaaaagttaagaataattactttaaatagaaagtgactctacatagtaaaacgaagagtggaagttataggaatcttaagcaagtcatctttatcctctctgggacttagttttctgaaaataaaaagcggaactaaagaatcttaagattgctctcaactctaacattttctaactttaggttaaaatacacatatatgtgtgtataggtacacaaatacatacacaaacacacacacacacaaacaaacacaccctcgcaatatgctaacaagtagccattgtgagatctaacccttcaggacagaaaattctaaaacatattatattttctaaaacatggtctgttgctccagggttttttgttgtcgtggtggtttggtttggtttgtattgttttgacagttattgatgtctttcttcatcttcacaagctcttttcaagcaagtcagagagagcatactttcatggcagatatttttttctcacatattcattcattcattcaacaaatacttattgagcatctactttctcctaggtcctgtgggttcagagcccctgcctcaaggactgtacagtttagtgatggagacagacaagaagcaggcaataacaatactgcctatgaagggacaaagttctgggaactgcaggaacatgcaggaaggataaccaactgttcccctggggttcagaaaaagttttcctgaggaaatgtcaaatttgctgccacatccaactttgctgccctatggtgtgctcagcctggagtggcagctatcatagatgggagctgtggtggacacctgcccctggatgagccatgacaggctctccttccagtatttcaaactgagcttgaagaatgagtcagtcagctggcattgaatggtgagattgtagactgtggtggcccaaattagaacaatggcaccaaaaaccatgatgccaaagtcatcaggaagtaagttctaagatccttgccaaggaagttggtctgtaaagaggagaacagccagccatgtagacagaaatgagatttctaaagacctaaaggccttggatatctacctgcttatttgacttccccagtgtgagtatttaacccaccagtatctcaaacttgatttttatgcaccaagtctcctctctcccaaggtcacccatcaggataatgacatcaccaatcatcctgttgctcaggtccaaacctaggagtatcattaattcttccttttgcttataccacacgtttacaccatcagccagttctatcagctttacttggggctgagccaagccatatcaaaccctgaagcaaaagaaaaactctgtacccgtacatattttttgaaccaaatagaaaaagttaagctctacagtgaaaaagcatgactatatataaaagcaccgtaatgcccaatcagttttcctatgattgtcaaccctcacaagcctgccagtgtgggaatatgagagccaagtggccttggaactgagcacaggttggaaacaactgttcttcttgcacaatgatgcagggtcataaaacaacaacctgtgttggttttgtttttgtttctttgggttttttgcattcattttgaatatagtaacagcaacaaagaacaaataccaattagacaaaatcagtactatgtgcgaggccctgttctaagctctttgtgtgcattaactgacttattcctcgcaattgacctaaaatataccattattacacctattttaccaacaaaggcactgaggcacctctaggtaaggtaatttaccagggccacacagctaagtcatcgcagggctgaaattctaacccaagaagtctgactccagaacaaacgaggtaaaataaactggacttggtgagcaattggctatgtgcaagagagaggagtcaaaaatgttcccaggagtctggtttgggcagctaggtggatagtgtgccattcactaaaactggaaataaaggttggggaggagtacaggtttatggaaagtttatagatcatatgggaaacccaattatgaacagtttatgggttcaatttaaggcttttcgtatttgagatgccaaggacctcatggtagagatgtccagaacatggcagtttcaatgtgctttgaagtcagacagcagatacttgatgaagacagtatatgagagtcaccaagtttggtgattagagtcctgggcatagccgagtaacccagaacagtcattagcatgtccacaggaagaatctagttgaataagaaacaaaatccctaaacaacttataattgtctgttcttcttaggcatgaggtcatttgcgcaagtcttaacagggtagattttagctcaaaagaaacatgattgagctgccactttaaaacaaaacaaaacacctaattaactgacccatcaccacaacagttggactggaaaaaagtcacctgatcctttggaagccaacaattggtgccgttaaaccattcaaattatatttgccagaaatgttttaagacctttgtaggttttaagcatcatagcaaagatatcaaaatccagcaccatcaaaagtatatatttttttggctgtgcatggtagctcacatctgtaatccagcactttgggaggccaaggcaggaggatcacttgagcccaggaggtcaaggctgcagtaagctgtgatcacaccactgcactccagcacaggtgacagaataagactctgtcaaaaatatatatatatttatacacacacacacatgcacacacacacatttgtttttctgtgaaaatgcttgaaagttttttaaattatttgagcaagaaccattcattttacttacttgtggctgtggttgtccaaaatcattaagcatactcagagactattataaggtgagaagaaaatctaacatacagttgtttgcaaatgaaaggaaatgtttataaatatgaaaacccataaagttatattttgtagacatttattaaacatttaattctcaatttataattttctgtaaatctgtcatctcaaggcaggcaagtctttcagggctttgcaaaaatgttgattaaatgttcatataatgtaaaataacatcaatttctttagttccttggcttccaataacctcatttcctgactttaatcactcatgaagtctgaccccccccttgctatccttgggttccatgacaggcctctatgttttttcagtagataccttcttttttgtttgtttgtttttgcctccttaagtatctttagtgagtttctcttccttgcaaccacaagtactgtcggaattgaaagtcagcttccttccacctaggcaagccccccactctgggctctgtgtgtttctctgtggtattttccatgaactgctgcccattgcttgggcctcctcttccttcctcattccctggcttggctatttaaaggtagttcattagcaccttttaaattatgataaaagctgtaaaattaggagaatttttaacatacccattttaaaataactccaaggtagaaaagacctgtttgaagctctcgaggagagaaataaccacagacacaggctttaaaacctccaccatgcagcagactcacgtaatcttatttgtctcactcaaaccctgcttcctttagtcttgtgctttttgctaccaaaggatttatattcagacaccacgcagttttccttctaaagctaaaggcttacgagagagttgagctagcctagaaacctatgaagagttcttaccttgaatcttgtctgcatttccatccatgcagatactgaaaagacccaggcaaaaaattaaagcaagctagtaataggattcactacaatcagaaaaaaataacaaaattcaggggaggtattgaaatatgaaaggtgtataaaatatcaattacacagcaaagcccacctttttacagttttcctccacagtggcaaaagttcagaatttaatagttgtgtgtcttcagacaaattacttacttagagattcttttccttatttataaaataggactagtcacagtttcttttcaacatgactgtgatgaggataatcatataactattcaggtaaagtccttagatcactcaagaaatggtggcttctgtgctcataataatgatcatgaaaagagtgtaatttacatacaacattcttagaaggtttaaattaatctgtgaaactttataataaatggccaggactagggtgaagcaagtgaaaccctagccttgggtgcacaattcaaaagggtaccaaattctcagtaatcaagatgcattatattttaatataatatttttgaaaaacaaattcgtaaactacagcccatggaccagctacttgtttctgtaaataaagttttattggaagttttgagaaacaataaagagaaaaaaggaccggagcttcctttataggaattttacaccctgagggtccaaagaagaatttcttatactagggcttttaattaacagccaaattcctagtgctaggagtgctgctgaacacttgcattcatctattatctttacagcctagactctctgtgggcaggagaaaaacacctgttcaaaaggtgggttctcattgtgagaggaagggtaacaagctattcagcaattcttggaaccaaaatgaacttgtttacccattttaacaagaacccaaggtctacagaatacctgcttttgactatatattggaaaaatcaatgagataaatatctgaataaacacactgaatactcgataaatatgagtcattttttagtaatatgagaattgttaatgtaatttgaagagtggaatccacagttgtactgcaaagatataagtgatgggtccatcaatcagcctgctgcagaacggggccaatgctagataaagggagaatggggcatcaacccagaaaatgggattgggtgctggtttttcttccaagcatgaggtatatatcctatcacctacaaaagtggctcagattactgaatgttctagcactaagcaattcttatagacagtacaaagcctcataacttaagttgccaaaaatttatccatttcttgaaacaggttttggatcagctctgagaaagagttcttttccaaacaaaagcctaactacacaattaaatgaaagggaattcattcacttggaggagaataatgaaagaaaacaagttattttaaatgataaaaaatatgaaccaaattggcaacacctttagaatgattgctgctgggtttgattaatgggatacattatcagctgaacaaaaaaagagtttatcagtttagtacattttttacttaacctttcaatgaaaatcttaaaacttttttcagcatacaaaaataggaggaatggcttagaaaagaaaattgaaatgttccagaaaaagcaaaaatctaccctctgagataactgaccaccacttttaacagcctggtgtttattcccttggatttttgaatgtatatatatttttaattggatccaactatggtttttgtctttcagtatcctttatctccttctagctttacactttgcccctctggcttcagaagttgtcgcaccacttttcctccttggccacagtgattgctccaagcactagacacatgaacatagccaggccaatgagaatcctttccttagatttttcaactactggaactctgttcttctctagtcaaggagctacaagaatgtagtaacaggccaggctgcagttgctcatacctgtaatcctaacactttgggaggccgaggtgtgaagatcgcttgagcccaggaattcaagaccagcctgggcaacatggcaggaccccatctctacaaaaaaaatgaaaaattagccaggcgtggtgatgtgcacctgtagtcctaggttctcgggaagctgaggtgagagaattgctggagcccaggaggttggggctgcagtgaaccatgatcatgccagcctggataacagagcaagatcctgtctgaaaaaaaaaaaacaaaaacatgataacagagttggtggcaaccatggctccactgtcatggaaaagctgcaaacagtcagcagcagagacaaaaggcagagagaaagtcttggccctgagagcattcaggttcctgattccattgctaaggaccctgatgtcccagtcattcccaaagctcttttgtgcagttctttcttcaattctctgagtgactccagcattgttccagttcttataactgtcttacacccatagtaagttccatttcttactgaagctattccccatgattgtctgccacttgcagccaagagaatcctactatacatactcttctgcaatttgattttattcagttaaaattgtacatagcatggacaatttccatatcaatgcacatctccctcttccttttcaatggccgaataatagtcctttgtatggatgaatgtttatgacctttttctaaagccagaaacacaagaaggttttaaaaatggtaaacacagaaaattatactcagcttgaagagctgcagccacattaggagtggtgattgttatggaaatgagaggccagcattgatgaagtttaagtagcacttattccccaaccacccatgtagtactcatcaaacctgtcttatgcagagtaatttttggcatttgttatcacctctgcagatttctaaaagttatgccttgtatatgcaccccagtttccctgcttcacccagcattgtaaccataactcaaccactcattcacagggtcttcaaacctatttgttatagatgaacaaatatttgagtgaagttgagaggaggctgtgtttgcatgagttgttgagacctggaaccataagtacaattagtaccaagtttgaatccatctgaagttttgaagtccactgtttctgccatgcagtttccaagacatggatcaactttaataaagagttacacttgggcttcacagtcatacagtaatggggtcaagttccagttcctccgtttgtacgttgtgtggtcttgagctaaggctcccctctaagctgttttctcattagaaaaaaaaagagggttgattaatagtacttatctcataaataatttgagaagattaaataagaaattgtgtggaaagtttctatgactgtgctgcattcatagtaaatgcttaataaacggaggctagcatcatcttcttcatgatattcaatacattctgttgtccagggctgtataccgcttccaccttccaagtttttcaactgccaaagtgactttcagaaactgttctttaaagagctgggtgctagccaggaaacatttggaagcaaaaatagtcctaaaaataaggaaaggacgcatgactttttaaatgttgagttttcctttaagagcaaaattaaactgtgagtaaagatcaaaattcattctttctgtgaccttgttccaaagtgaggtttattggagcataatacatgtcagatgttgtttagagtggcatgtgcccttctcaggatatgttgaacatacgctgtgtgtctaggggtttttctagcaggtgttttggggctgaagagagaagaagggttcatttgacaacaacatccacagccctcaggttcaccctggattatgttcttcaaagtacaaacaggtataaaaaggataatttcctagatccttaaggcaaatagtttgtgaaatcgaattcaagggactttcccctgatgatattatggccttgggaattcagattaattgttcatataaaatacagaagaggaaaaaactgcagcatggattgggattcaatttaataccttccaagaaattgtcctcttcttgcagtttccattgcttaacaccttcttctcccaccactccaccttgttaacttctgttcttccttctgccacaactcagatggcattgcctgcagcagcactccctgagtcctctgttaggtgccgtgctatcaaatctcattgcccaccacacttcttcatagcacttaccaagaccatcatggaataactgactcttggactcagtgctttctcacccacacaactgtatgctccagtttcaccaggaatgggaccacttctatcacgttggccccattgccaggtcctttgtaatgatattataaatatctgaaaatcttgagaaaaaatttgatttattcaataaattttgactttagaaaacccaatgagtagctaatttgctaaggagttttccttatgatggtcagaagaatgtctttattccatgtaatgaaaaaaaaacccactatagctatttgatattgtattatcgacattctctgaacttatttggttatcagtttcaggaaagaaagtgataattataataattagctctaattggatgtgtaaatggctacattcaaaaaggaattgaaagagactcacgtaaaaggggtcttgaaagccataccttacctacctgcatagtcatgctacacaagggtggcagacaaaagccagagtgaacaaaagacaaaagccagagggttattgatgacactgctcaccccgctgaagcacctgcagcactgggtttcagtacgtcgactggaagaaacttctgagacagcttccccttctcagagccagctagcctctgcttggatcctctctgtgagaagggactcacttaacaccacgaggcagtccattccattattgaatggtttaaaggattgggtagtttcttcctacattaagacaaaaatgtgtttggctctaattccacccatcaaaatcattctgcatctggcagatgcaccaaggctaacaattttagttccagcataagacaaactcatttttgagtattactagctgtgtgatcttgggcaaattgcttcaccccctctgagcctcaatttcttaaactagacactaaatcttaacctgtagtcaaaattaaaaaataaattcatgtcaagcacgtagccccgtgcttgattcatataaagagagagctgtgaactctccatattctttcttctacatggcaagcattcaaatatcagaagacaatagccccatttagccttttttttttaattttttttattatactttaagtttcagggtacatgtgcacaacgtgcaggttagttacatatgtatacatgtgccacgttggtgtgctgcacccattaactcatcatttaacattaggtatatctcctaatgatcctaatgctatccctcccccttcccccaccccacaacaggccctggtgtgtgatgttccctttcctgtgtccatgtgttctcattgttcaattcccacctctgagtgagaacatgtggtgtttggttttttgtccttgtgatagtttgctgagaatgatggtttccagtttcatccatgtccctacaatggacatgaactcatcattttttatggctgcatactattccatggtgtatatgtgccacattttcttaatccagtctatcactgttggacatttggcttggttccaagtctttgctattgtgaatagtgccacaataaacatatgtgtgcatgtgtctttatagcagcatgatttataatcctttgggtatatacccagtaatgggattgctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgatcgccattctaactgctgtgagatggtatctcattgcatggtactggtaccaaaacagagatatagaccaatggagcagaacagagccctcagaaataatgccacatatctacaaccatctgatctttgacaaacctgagaaaaacaagaaatggggaaaggattccctatttaataaacggtgctgggaaaactggctagccatatgtagaaaggtgaaactggatcccttccttacaccttatacaaaaattaattcaagatggattaaagacttaaatgttagacctgaaaccataaaaaccctagaagaaaacctaggcaataccattcaggacataggcatgggcaaggacttcatgtctaaaacaccaaaagcaatggcaacaaaagccaaaattgacaaatgggatctaattgaactaaagagcttctgcacagcaaaagaaactaccatcagagtgaacagacaacctacagaatgggagaaaatgtttgcaatctactcatctgacaaagggctagtatccagaacctacaatgaactccaacaaattcacaagaaaaaaaacaaacaacccatcaacaagtgggcgaaggatatgaacagacacttctcaaaagaagacatttatgcagccaaaagacacatgaaaaaatgctcatcatcactggccatcagagaaatgcaaaccatttagccttttctaggctaactcctggtttctttggccatttattctataaggtgccttgtgacatctagctaattaggttacaatgaactcccagaattgaatcaagttctgcaggagatgattaattcaaactcgtagagctactgctcccaggtactctgaaggctgaggcaggaggatcacttgagttcaggagttcaagatcagcctgggcaacacagcaaggccccgtctccaaaaaagaaaaaagaagagctactgcagtggggaaagaaggtaacaggggaaacacctcagtttgtgcaggtgcacaagaggcatgtctttcccacgtctgcaccctaacattctatgtatgtagggaagatttcaaccatgttagcagtcccctcagactagtgacttagtacaaccgaactcttttaaaggtaaattttattgttcttgtgttctagttttaagagcagcatatgttcaatacaggaaatttttgcaaactcttgaaaagaaagaagaagaaaaatcttccatgatactatatccagagataaattgccattagcacttattgtgtcttttttcatttttaatttataggtgagttgatattcagcaacttccatttacatcttattggtttaataaggtaacctctagctgcaaaggaaactgggaaatatagtttcttttaagggtcactctgatgccttgaataaaattccggtttattaataaggaatatggggaaatgaatattgggagggcaactggcagtgtccgctgaacttgtctttttgaacatttctcttgttttcaatttgtctgtattataaacaatgttttgatgaatgccttgtaggaaaatctttgtacctatctatgattattccttagggcatgttcctaaaagcaactgtagggcttaaggatatgtgtctttcaaagctattgtttcatgttatgcaataattttttaagcaaacacagcatgcgacatttgttgttcttaaattttatctgttagattttaaaagcttagttatttggcattttagtgtgaattctgatctccttcccagatttatcctatttaaattactaataaaaagtcttggctgagtgtagtggctcatgcctataatcccaacactttgagaggttgaggcaggaggatcacttgagtccaggagtttaagaccaacctgggcaacatggcgaaaacccgtctctacaaaaaaagtacaaaaattagccaggtgtggtggcacatacctgttattccagctactcaggaggccaaagtgggagaatcacttgagtctgagaggttgatactgcagtgagctgagaccacgccactgtactccagcctgagtgacagagcaagaccttgcctcaaaaaaaaaaaaaaaaaaaaaaaaaaaaaaaaaaaaaaaaaaaaaacagcctgggtaaagggttctgtgacattccatgacagacctaccttcagtctaacactgagccattaaaaagccttctcggcacaattgtttaaggagccgtgacttcattttacgctcaattgacaaatgttttctgaatgctttctatacactaagcactgagctaggcaacatatgtacaggatgggtaagctctcattcctgccctcaaatggcctaaaactactgtccagctcacatttgccaccttgtccctatggatgcgcaagatactttgtcaaatgctttgtccatatcaggatatattttgcctataatatgcctgtgaaattctggtctgataatccaacccaaaaaggaaataaggtcaagttggcttcatttggccataccatcatacatagactttgccactcagatcataagcaatcatacattgcatttattttgtactcaacccttagctaagcacatgctcaataaagatctgttaaacgaattaataaataaatggatgtgtgaaaaagttcatatttactaattctgaaaccaaatgaggcttactgctctattaaaaagtacaataaacctctgtcttcattctgtgtatgaattgtgagcaagtatgtgtgaatgtatttgtaactgtgtgtgggggtgtgtgcaagtatatgtgtgtaaatatattgtgtcacttcataataaagtagtggttttataaaattctggagggttactccacagtagttattttataccctctttgttaattctaaaagtcatcgaaaagcaaaacatttaaataaagtaaatttagttatagactaaacccatagatccacctcattttttaatataaaacaagagatggaaaataatctaatgttttgtctattttgccaaaacccaaaatctttctcctttgggcaaggaaatactcacaccataaggagtaattctttaattgcttctaattaaaataaatgcccatgcactctgggtctctgggaacatgactaacacttgcctcaccttgcagatgaagcgtgggtaaggttgtgaaaatagtgggtatcacctcaacaccaccgcctcctctagccttacagctgaaatcaggcacccaccaatatcagtaggcccagggctctttccaacagcaaagtatgtgagactatcaaggaagctcagatattgagtcagttcttgaaacagatttttgcggaagtagcttagtaattagaagaccatggctttggagaccaaaagacccctcagccaggtgaggaaagacagacagacagaaagaaagaaagaaagaaagaaagaaagaaagaaagaaagggagggagggaagggaagggaagggaagggaagggaagggaagggaagggaagggaagggaagggaagagaagagaagagaagagaagagaagagaagagaagagaagagaagagaagagaagagaaggaaagcaaaggaaaggaaaggagaagagaagagaagagaagagaaaagaaaaagaaaagaaaagaaagagagaaaaaggctcagagagatgaggtgacttgcctaagctcacacagctagtaaggtcaggctctaactgggtcaaatgcctcacagattcaagctcttgaccaactgctagacaactgagcctcctaccatctgacatatttaaaacagctccagaatgcccaccccaaccttcaaacaagcagctgtctcttcagaaggtgctgcccacacagccataggatataaatttgtaccagcctactcggagtgggctgtggttggatgttccagttttaatcgtcaacagcagtgcccaagtagttctggccattcagtctactttgtgggagaaaaggcagctggcagtctgtcaaagcaaatgctgaacacataaaggcagaggttggggagcagatgtagtctccgctagtaacaaagattaaagaacatatttcttccgtgagaccagcatctaaaacataaaatgataaatgaacctcagcttctgagcagtggaaactttttccaggttatcaagaataacagcaatatatttaatatgtttttgagtatctgtatgcttcttccttgccttgatcattaatttgagaaagtacataattaaaagtaaacctattcatagcatcttcatcccaaggggctgaagcactttaatgtcataagtaagccaatgagatttatggctggtctctgcctttaagacttgccctttgaccttaggtgaataattgtaccactgggagttcattagaggaagtagaaaccaggactgctgaccctctctcattggctgtccacaggggaagacccagcagcaaacagataaggctttaatctgtcactgagtttcattatggtctgacactgttccctgttgcagaacatgtcctttgtagcatttacaagcccacaagaagctgacgttaatgaccgctggtagcacattttagctttccatttgtttgatttatttcatcctcctaacaaccttttgaggagcttagtgctgatattatccctatttgacaaataaggaaaatgaggcacaaggcttacctagtttacatgactgggaccagaattgggacctgtgacctctccaacctattcacagccaaccgtgcttatgcagagattgacttagaacccccatcttgaactctttttggaagtagatgtgatacaagccttaaataaatgaaggtgtatatgaaagctatgggtccaggggtggggaggattaaacactggagaactcttcagctgaacttgaaggactcccgtaataataacagagccagccaccactcattgaacaattgctgggtgctgggcactgagtcaagaactttacatggatacatcttctcatttagcactcgctacaactgtgggaggtgggacattatattccccatttgcaggataaaggactgtatcccacaaagtagctctccccagatctggacattccttatatcaaagccattactgctcaccaaaaccccatgctgttttctgtaattaatagattgggggaatgaaaggcatttcttaaaagtaactcagtggtctgaaccttaaaaacgcattatcttaagattttgcatgccaaaaagaaaaatcagtcaagtgtgttgaagggacatttaagttattcttacatttgtcattgttatatacagcatggcagagtatttaaccaggatggccagctttgaagcatgagagcctttctaagcctcagtttcctcattagaaaaatggggataaaattataccacctcataatgttgttttcagaattaaatcatataatatataaagcatttagcaccacttttttacatataggcaatcaatgaaaggtggctgctatcacatcatagtaatataatgatgttgcttaaaataaataggacagatactataacaagcaaaaggtatggaattcagatgatagctttttagtctattctatgctaacaactatttatttcctattgatgggtatttaattggtgctttttactggaagcttagatttgtgattttgtttggtgaggaggagtctgcagtgattgtatatacaatgatgatttcttctgcttgataaacagaaacccagaacagcaccaacagtggggtagaaaaatatgacttattagctattttactaatgcaaaatcagcctggggaatgccaatgcatcagatgaggaccatgcaggagatgccagcttttcttcatttcagaaaattatatcagagcatctaccaaacggcatccaaatgttcatagggttggccttgcttgtttaaggtaagaaataagtgtaatgggcagtcccaggagcatcccaagtctctcagtacccaactatgttgaaagtctatatcccaagcctctcaataccaccactatgtagaaagaaacagcagcagctccagctagctgtctccctgtcatgacttgatgccattggaaagttctggatcaccaggacttaccgatattcatcaagaagccagacagaaaagccctgcttgtctatgtcaatgttctgtcaacagtaacttgtctatagtcatctatcttttatggtttgagatcccattttcatacccattgtcttcataactttgggcaagttctttcccccgagtcttgatttcctcatccataagttggacaaaataacagaaaactcaaattccgtttagaaataactcaactttgggctggcagccaaggctcatgcctgtaatcccaacattttggggggccagggcaggagtaaggttcgatcccaggagctcaagaccaacctgggcaacaaagcaagacccctctctacaaaaaatttaataattagctaggcatgttggtgcacatctatagttccaactactcgggaggctgggaaggcaaaggcaaagattaggagagcgtttcagactgagaatggtgaagttctggcttagggatggggcagctctcagtttgtccaacagctgaagggaggcccctgcaggaggggttagattggaagagggagtggatgctgtgataagccatcccaatgcccccacctatcacctgcttcaagactgaggcactcgatcccctggcttctgctagcactggcgactgactgctcagctgatccttgtctgggaattcactttggctgaagagagctgcctagcctaaggacttggtcctccctgggggaagcctgcatgcaatgacaagtctatgatgtatgtggaatcggggggcaggtgttggtataaaggcctgaccccttccttgctgtaattcaagacaacttcagagcttcctgtgagatcagctgaggactttgccatgagtgcctcacaatgcaacttctccattggcccagtcctgcttttctcactgcccttccatgaggatcctgtgcactccctgctaagcttcctgcatgcaaatcttcatctcaggttcttcctggggaacccagagcagaagtggaaaggacatttgcaggaactattccagtagcacaagcaaaaaacaaagaggggttggactagaatagtggttttggggatggagataagcagacaaattttagatgaggaggtagaggttggagaatataaggttatttgaaggtagggaagctgaaagcaagacaggataactaacaatgctgagtctgaggcaaaaggaaatatcagtaatagcgatcttatgtttatttaaaattattgcattttgttcaccatgggggttttttggcattaattttgatttttaaaaatattgcttctctttcctgctgagtgttttggcatccccttaaattttgcactccagacttgtacctcacttacttcaccctagtcctggccctgaaaatgtttatcttaagacactaagttttggaattatttcatttttttttaaatttaaggtttcttttaagagacacatgtctcactatgttgcccaggctggtctcaaactcctagcctcaagcagtcctcctgcctcaatcccctcctgcctcaattcccactacacctgggtctggaattgtttcttgcatagcaataggtaactaatgtgctagcaaggagtcctttggaaatttacttaatctctcaaagccttggtttcctaatctgtgaaacagggataaaagcatatttcctatggttattttaatgattaaatgaaatatttcagagaaagcccttaacatagtgaccatcacacagtgtttcaattcaatgtgtccacaattgtcatcaatgaaatcacaagagtgagatcctcattttaagatcctggagtaatattatcatttttttcaaaatactaggcagaacttcctgttctgtttcttaaataagtttttctaaatgttctctcttctaatggtctttgtgggcataaatttaagtatgaaagatagtgcctagttgcttaaaaggcaactggtaatgcttactactctgaacgggaacaggacaccctgagttactcttttaattactattcacgtttattgaatactcatgaagtgtcagggctctgggacaagggcatcattcattttgatatttaatcccacaggccacctacaaagtgagcattccccatttcccccaattaatccccattttacagatagggaaactgagggaggcctagagaaggtaaacattttgtacaaggtcacagctggaaggcattgttctcaaggtctctgcagcctgtgtacagtttgcaagtggaagtatttctctcaattccagctgtgcccttgattgggcaaattacttttccatgacccacagcaaaaattacatctgggtgtctcacccaaatgtaataagggtgtttcgcccattaagggttagtcctttgaaggatttctctattaataatatgaattgtagactgacactgagtcagcacgttgagtcttactggtatccccgcttctgcatgaataacagcatgtgctgagtaagaggttcggagctgctttaattccctccctgtggctttcgcctcaagaattggcttactccactgctgtggcctgatatgccagcacaacacagcagccttcttgggttgcaggactccaattttttcagtaccttatggtctcctttgcccttgaactatggatatcgacttttcactttaatgcacattatctagagaaattcaaagccaaagaaaaacattccacaagacctgcctctgtaggaattggaatagagtaggaaatagaaaagtttgtgtgagggccatgtttgttcccacgagtccagacttccttgcacagctggagggcttctcttggggagactcaacatgagccaaaacatctggacttttcgctttaaaaaatctggtgtctgccatctacaagccatagtatacatttttgttctttatatttagtaaaataagaaaccttttgggagaagagctcattgtcttagtgcaggtcattaagtatttgctaagcacagactatgttgcctgccaagcactcatcatttgtcttgtgttccagcgtttcaagaagtttaaaatcagatccaattaaaagtgatgcccctctaaagaggcataaatgtccttatccaagaaaacaaaacctttgaccttctgtgttgtagaaatcctgcacagtgatagaagcttatgtacaacactatgcttataacagggggaaaggaattgtttatgcacattgaggttcaacttagcatcagtgattcattccacactgtcaagagtgtttaccaagcactcttcctgaaaggtctctgccagctggagaagtctctggcgtataattcacagaatcttatacctggacagggtttttgaggtcatctcatcaaatactatcccagtgcagggcttcctccctgaccttctgacagatggtgtgcacattcagccactactccagcagcatctttcctccaaccttcccctggtcctgtgcacaatccactgctaccccactgagtctctgtaatgtgaactgaattatgtccctcccaaattcaaattatgtggaagccctaacccccaatgggactgcatttggagatagagcctttaaagaggtaattaaggctaaatgggttcataagagtggggccctgatccagcctgactggtgtctttgtaagaagaggaagagacaccaggggtgtgcacacacacagtaaagaccatgtgaagaggacgcagcaagaaggcagccatctgcaagccgggagaatccgaccctgccagcaccttgatcctagacttccagactacagatctgtgaggaaatggacttctgaggttttttgggttttttgtttgttagttggttggtgggtttcagacggagtcttgctctgttgcccaggctggagtgaaacaatcccggctcactgcaacctctgcctcttgggttcaagcgattctcctgcctcagccccccaagtacctgggtctacaggtgtgtgcaaccatgcccggctaatttttgtgtttttagtaaagaccggatttcaccatgttggctgggctgggctcaaactcctagcctcaagtgatccgcctgtctcagcctcccaaagtgctgggattataggcgtgagccactgcacctggtggaatttctgttttgaagccacccaatctttggtattttgttctggcagcccaagctgactaagacacttccttctagagttttttggccttctacccagcctgcctctttggtagtttacactgtcctgtttttagtctttatatgagatttaagcctattctaataatgctcccttgttcacactttgctttatcagtatgtgtctcatctcccaaagcacattattaactcataggaaaaaacaatcaggttaaacaagcctctttttttctgaagtgcctagaaggaagcagtatagactctggggatttaataaatctgaattgcttaaataaatggtaaactactcctgctagtcggcagttacgttcctcagatacattaatcctcagttttcacatctgtaaacaggtaataaattctgtctcttaaatagaatgtatctgatgagattgcagtgaagattaagttagataaatttgtctggcatatagtaagtgctccattaaaagagaattattattattattttattgtaaagccacacctgggaaaaggaaagtgatctcacccaaaaggtataaaatcgctgcggattcagttctgcagtatatgaagaagtatatgtctcttgcctttcactttttcttgttttgagatgagccacacagcattgtactggttagaagagataaatgatggaacccaggttcccctctctcttcactggcactccagggtggaatgctttttacctcaataatgttttctagccccattagttgttacgtttctgtttgaatagcaatgtgatgcatccaaagcatcaactacactatgttctatttactaaatgcattaaacgtaaggatgaagaaacgttaaaagatggacttgccaaacatgattctgagcaaactgtaccaaaagacaactaacattttattagaaaacttctaattaccacatgcaggcaatcctgtcacaggatttcagcctttgtggtgattcattctccccaccccatgacacaagttggaggaattatccagtgattgtacagtttgcaaacattaatgaatctggtgccttagatcatgtttatgaataatctgttgcaatactcaccctttcatttggaatctttgcaaaggattccttttgtgtctggtccaggaatccttccaatgctaaacagactttccacttcccaaaacctcactatcccttctgatatggtttggctgtgtccccacctaaatctcgtcttgagttgtagctcccataattcccatgttgtgggagggacccagtgggtgataattgaatcacgggggttgttcccccccatactgttctcatggtagtgaataagtctcacatgatctgacagtttataaggggaaacccctatcacctggttctcattctctcttgtctgccaccatgtaagatgtgacttttaccttccaccgtaattgtgaggcctccccagccacatggaactgtgagtccgttaaacctcttcttctttataaattactcagtctcaggtatgtcattatcaccagggtaaaaaaggactaatacgctttctaaggtcaagagcttaatcaatacaaattgaattttgcataagtcaatttaaagatgactcttataagttaatacagacctaagctatgtattctcagatctttggattcaatagaccagtatctaaagcctttgttagtggtttatatatccatagctgtctgttatgataacttttgcagaattgacatgcgaactgatcgattaagctgccaggagacttttgtgatttgattctcaatgaaaaattttgggggtaatatccatctcactttttttttctgagagggagttttactctttttgccaaggtcggagtgcaaataatggtatgatctcagctcactgcaacctccgcctcccgggttgaagcgattatcctgcctcagcctcccacatagctgggattacaggcatgagccaccacactcggctaatttttctatttttagtagagacagggtttcaccatgttgttcaggctggtctcgaactcccgacctcaggtgatctgcccacctcagccacctaaagtgctgggattacaagcatgagccaccatgcctggccccatctcacttttaaaaaatattctaataaagtccttggctggcaaccagaaggataaaataaaaagaatcaaattatctagtggtgttaaatataaaacggaaaggaataaaaatttaaaaggatacagacacagggaatagtaatattccctgcctcaatattttggtttacacagttcctttttatctttttaaaagtataaatagtacatgcctattgtatgatacaaatgtgtaccaaacagtgaaaaggccctccactttcccctggtagatcagtctttcaataaaacctaatgttaatactttagtgtatggccttctagattcttctgtgcatacatctacaaatgtatttgcctcaatagattatactatgcataccattctctgccctatattttttaatccaacaaaatattgtggatatgtttccttgcctattcatataaatcaatgttctgaatgactgcatagtaattgctgaaccacaacttatctcctactgataacatttacattggttctaatttttttaccataacatcagtggtataatttctgcatgattgtaataaaaagatgcttcatatttatttatacttctttaagttaaatttctaacatagttttgccgggtcaaaaagaatacccaggtcagacacagtggctcacacctgtaatctcagcactttgggagacagaggtgagaggatcacttgagcccaggagtttgagaccagcctgggcaacatggcaagaccccatatcttaaaaaaaaaaaaaatggctgggtgtggtggcacatgcctgtagtcccagctgcttgggaaactgagatgggaggattccttgaacccaggaggtcaaggctgcagtgagctgtgattgcaccactgcactccagcctgggtgacaaagtgaggctctgtattaaaaaaaaaaaaacaagaatacctattgatattttgatagattctgccaaattgccctctaaaaggttgcaacaattaaaaccctcaggagtaatatacatccatacttatttgcccaatccttcagaaaatttgggcaacgtagataattttcatttttatagatttcttatttttacatttgaatgtataatcttttataaaatagtaagatgaagagatgaagggccttgctattgtttacaaactatgtgacaacagactttaaagtttaggttttttaagttaattcaggcaataaatctttaaaacaaaaaaaaaaatctcaggccaggtgcagtggatcatgcctgtaatcccagcactttgggaggctgaggaaggaggatcacttgaggccagtagtttgaggccagcctgggaaacacagtgagaccccatttctataaaaaagattttaaagattagccaagtatggtgatgcatgcctgtagtcttagccacccaggaggctgaggcaggaggatagcttgagcctaggagttggaggctgcagtaaactgtgattgtgctactggactccagcctgggtgacagagtgggaccttgtatcttaaaaaaaagaagttaaaaacaaacaataaaaaacatattatcttctcttcctagaccacatcctttcgcaaccatttgagaactaggtaaaaattatcagtctctattgctagctgaagctttcaccttgactgggcttccaccatcaccaggtttgattgcaaagtgtcatttcttttcttgggtgagaagcatatcaaaatactatcacttgcttaccctgccccgacatgctaggtttgattcatgttggaataatagaaaggactaaagaattcagagcagttctgtactctcgcctgacacctaacaccaatcggtttccagcccacagagctgtgcagtggaatctccaaggcacattctagattccctagtgtcactccagtgagcaacctttctacacacttcagcacctggacagctctcttggcaccacctctagagggcatggtaagccgctttgttgagccctctagtggttgctttagttattgcacaactgtttttaaaatttcaggtgtacctcggagatattgcaggttgggttccagacaaccacagtaaagctagtatcagaatagctctggttctgcagtgcatataaaagttatatttgcactgtactgtagtctattaagcgtgcaataacattaggtcaaaaaacaatgtactgacttggcaaagtggctcacacctgtaattccagcactttgggagacaagggtgggaggatcacttgagcccaggactttgacactactctgggcaacacagtgagaactcatttctttaaaaaaaaaaaaaagattaaaaattagctggacatggtgctgtgcatttgtagtcccagctgctcaggaggctgaggtagggggatcacttgagcctgggagattgaggctgcagtgagctatgatcatgccactgcattccttcctgggcaacagagtgagaccttgtctccggaaaaatgtacataccttaatttaaaatattttattgctaaaaaattgctaatgatcatctgagcctttagcaagtcataatatctttgctggtgaaggttcttgcctcagtgtggatggctgctgacagatcagggtgggggttgctgaaagttggagtggctgtggaaatttctttaaaaaagacaacaatgaactttgttgcattgattgatttttcctttcatgaaagatttatctgtagcatgtgatgctgtttgatagcattttacctacagtaaacttctttcaaaattaaagttaatcccctccaaccctgctgctgctttatcaaataagtttatgtaacattctaaatccttttgttgtcactgcaacaatgttcacagcatctttgccaggagtagattccatctcaagaaacaagtttttttgctcatccataagaatcaactcctaaaccattcaagttttatcatgagattgcagcaattcagtcagaccttcaggctccacttctaattctagttctcttgctaattccaccacatctgcaataacttcctccatggaagtcttaaacccctcaatgtcattcacgagggctggagtgaacttctttcgaattcctgttcatgttgctattttggcctccttccatgaatcataaatgttcttaatgacatctagaatcctttccagaggattttccatttattttgcccagatccattggagaaatcattatctatggcaactatagctttatggaatggatttctacaaataataaggtttgaaagtcaaaattactcctggatccatgggctacagaatggatattgtattattagcaggcaggaaaacattaatccctttgtacgtctctgttgggattcactcaggatggtggcagaaatattaaagggaaatattagggaaagttatagggaatagtcacaaacctctctggaaggctgaaaggttacatagcttgtaataattgaacaggctgaaggctgccggttcttaccttagagcattaagtcataggttaaatactagggacaatagaggcttccccagttaagtctgtttaccctacctccattaactaacctttgagccagatggccctgggggggtggcgggagaggtctaccaggaaaattgcccccaatggtatttactttagaccacagtacctgagctttaatcattcgtagaactactctcttaaccatgttaattatccacaagtgtgttgactcaaagcttccattgttaattctacactaaataaatgcctggagtgcgaaccgttcagggcaacacctgccattctttacaggactcttcttggagtctgtgagtggcctcggaccctcagctggactggcaaagcagaatatctgtgtgtcagtgtatgtttattcatccgtcaccaaatcaggggtctgcaggaacagaccctctgcagctagtgctcccaagaaaggagcgctgcctcacatctccatcacagctcatgggtaaccagatgctttgtgaatgagtggtaatattttgaaaggaatatttttttctgagcaacaggtctcaagagtgggcttaaaatattcagtaaaccatgttataaacagatatgccttcatccgggctttggttttccatttgtagagcacaggcagagtagatttagcttaattcttaggactttagggttttcagaatggtaaataagcattggcttcaactcaaagtcaccagctgacttagcccctaacaagagagtcagcctgtcctttgaagctctgaagccaggcattgacttctcttctctagctgtgaaatttctagggggcatcttcctccaatggaagtctgttttgtctacactgaaaatctgttttttagtgtagccactttcacaaatgatcttagctagatcttctagaaaacttgctgcagcttctccatcacttacagtttcacctttcactttcgtgttatagaaacagcttcttttcttaaacctcattagtcaaactccgttggtgtcagacttttcttctacagcttccttacttctctcagccttcatagaattgaagagagttagggccttgccctggattaggttttggtttaaggaaatgttgtggctggtttgatcttctatccagaccactcaaactctctccatatcagtgataaggctgttcaccctcttatttatatgttcactggagtaacactattaatttccttcaagaacttttcctttgcattcgcaacttggctaactgtttggtgcaagaggcctagcttttggcctgtgttggctttcaacacgcctgcctcactaaatttaatctagatattaaagctagaaatagtttctgatttgaagcaagagatctgcgactcttcctttcacttgaacaccaagaggccactgtagggttattagttgatctgatttcaatattgctgtgtttcagggaatagggaggccaaagaagatggagagatgcaagaagacccggtcaaacttaatttaccaattaagtttgccatcttacatgggagtagttcatgatgccccaaaacaattacaatagtgacaacaaaaatcactaattgcagatcaccataacagataaatcataatgaaaaagcttgaaatattgtaagaacgaccaaaatgtgacacagagacatgaattgagcacatgctgttggaaaaatgacaacaacagacttgctcaaggcagggttgccacaaactttccatttgtaaaggacacagtatcaacgaagctcaataaagtgaagtgcactaacatgaggggtgcctttattcagataacacatgaaaatgttataaaacatccaaccattagggctgggtgcggtggctcacgcctgtaatcccagctctttgagaggctgaggtgggtggatcacgaggtcaggagatcgagaccatcctggctaacatggtgaaaccccgtctctaataaaaatacaaaaaaattagctgggtgtggtgacgggcgcctgtagtcccagctactcgggaggctgaggcaggagaatggcgtgaacccgggaggcggagcttgcagtgagccgagatcgcaccactgcactccagcctgggcaagagagtgagactccgtctcaaaaaaaaaaataaataaataaagccaagcatcttaaaaatacagagtaaatgtgcaagttcctattatccttcctctcctactttccttggaagttagcactgataaaacacaagacatacatatatttacttaccaacaccttttgttttgtgaatggactcattctaggcccatttgcttttatttttagttaacaaaattcctaggcgattttttaaaatctcagtatacatatctcttacatattcttgtaagacattatggagaagcggctggctgtgtgtgctagcctccgactagtcatgatcctgattttgccacttcctaattgtctgatcttgaccaaatcccttaaactctgtgtgcctcagttattcatctgtgaactagggataaaaaaagtatgcgtcttagagtggtggaagggaagagaaatgataaaatataagtaagcatttagtaaatttagcaacttttcttcttttaagagacaggttctcgctctgtcaaccaggcgggagtgcagtggcatgatcatggctcactgaaactcaaactccttggctcaaatgatcatcccacctcagcctcccaagtagctaggactgcaggtgagcaccctgccaaggtaatttttttttagagacgaagtcttacaatgttgctgaggctggtcatattattattttattactattaattatatattagctggtacataatattccatagtgttctgggctacatatttgtgtaccctgagaattcctgttgaaatcctaaacctcaatgagatggtttcaggagatggggcctttgggaagtgattagttcatgtaaatcctcataatgggtttaatactcttgtaaaagagactcccccgcaaaaaaacagagacctcagagctcttggccctttctttaagaagacagcaatatatgaaccataaaatggtgctccccagctaccaaatctgctggcaccttgaactaggacttcccagcctccagaactgtatgaagtaaatgtctgtggtttaagccacccagcctatggtacttttgttatagtagcctgaactataacagggattttgtatcataacttatgcaactatgtttctgtaactaagaaacatagtatggatgtatcataaattatgtagtaactaccttattaatggacacttgagttgttttctagttttctctattgcaaacaatattgtaatgaacactctagcatatatgtctttatgtccatatttaagcaagttttttaagatctattcccagcaggagagtgaaaatcagttaacttccaaagtctcctggagttcacagctttgattgatttgtacatgggtgctaaattaagagagataaaaactgagagacaatctctcctagagagatacacatagtgttggcataagtactatgaaaaaaattaaaagctgtgtgagtggataggagggaattggggaatgatgtgtgggacactctagataacaaagacttctccatggggatgaaattagcaaagggacctgaatgaagtaaaagactaaacacagcaaatgatttacaaaatatgtgggaccagcagccaggcaccgtggctcacgactgtaatcccagcactttaggaggccaaggtggtcagatcatttgaggtcaggagtttgagaccagcctagccaacatggtgaaacaccatctctactgaaaatacaaaaattagccaggcatggtggcacatgcctgtaatcccagctactcgggaggctgagacaggagaatcacttgaactcaggaggtggaggttgcggtgaggtaagatctcgccattgcactccagcctgggcaacaagagcaaaactctggctccaaaaataaaaataaaaataaaaataaaaaattagccaggcatggtggtgcatgcctgtagtcccagctactcaggggactgaggcaggagaattgctggaacccgggaggtggaagtggcagtgaccccagatcgtgccattgcactccagcctgagtgacagagggaaactccatctcaaaaaaaaaaaaaaaaagtggaactaggaaacaatcctgactttctggtcctttcgtcccatccccaggggaagcaaatcctgtgtctacccctctgcctatcctacttcacctatacgtggtcttgccttgtcttggggttcccccacatgtctgtcttatcctaccttgaacataatctgtttgcaggcagggcttaattccatatgcttagtagtcccacagtttcccaccaggacagggtcctgggttgtatattccataggcattcaaatgttaaatggctcagatgaggcagctgctctaattaaataatccctgaagttcttatgcaacatggcccttgggctcttgtattcactgagtagaactcagtgacaggggaacctgactggggggcattcagatgtgtattctgcagttatcagtattgtgaacagaatgaattttttaactagcacctatgctttagccaaagaaggctatttcatgctggagcagtctgttagatgtggagtccatgcttttaggtagaggcctagagttatctgagggtttatagaacgtattttgcacttgtgtgttttgttttgggtttcaattgtaccaattcggatgctttgggctccaagcaaggaaaaaacaaacttaaactggcttaaaaataaagaaactgtattatctcatgaaacaattcttcaggtgtttgactccatgggggtaatttatttgggtattcaaagacaccatcgatccagattctttttatttttctgcttttctgtcctccataaggcaaggtggccctctgatcatgagatcaggtcagcttctctcatgatctcaaggtgctaccacacttaggcagatatgacaatatccagcaaaaatataaaccaaacgagggactatgccttagggtgtatctcatcctctaggaaaacttagaagctctcaagatttttcacttctgattacccataactgagtcacatgtgcatgtttaagtcaatatctgtcaagggaaggggcctaccaccattggcatgggtgacagggattcagcccatttctcacggaggaaggtggatacctaaaccaagctggagtttcgttagagaggaggaaggcataaaggttgttggggtttgggtactacattagcttgctagggtaactgtaacaaaatactagagactaggtggcttaaacaacaaaaatttattttctcacagcttcagaggctagaagtttaagatcaaggtgtcggcagagttgatttcttctaaggtctctcttattggcttgtagatggccatcttctctctatgtcttcacgtggtcttccctttatatatgtctgcgtccaactttcctcctttcataaggacaccagtcctatcaaattaggcccacccatataaccttattttaactcaattacctctttaaaattgctatctccaaataatcatatcctgaactccagcatgtgaatttggggagacataatcagcacttaacaggtaccagtgatgactgccactagttatttgcagagcatataaagaaccaaaaagaagaaaatccaaattacttgtaatctcatcacccatagggacccactctatataccttctagtcatttcttatgtgtacacagctaacacagacatacgtcctttttaacaaaataggatcctactgtgcctactgttttgcagtctactttttttttttttttttttttgagacggagtctcactctgtcgcccagcctggagtgcagtggtgcacacaatctcagctcattgcaacctccgcctccccggttccagcgattctcctgcctcagcctcccaagtagctgggactactggtgcatgccaccatgcccagctaactttggtatttttagtagagaccacattggtcaggctggtctcgaactcctgacctcgtgatctgcccaccttagactcccaaagtgctgggattacaggcatgagccactgcgcctggcagcagcctacttttttatttcatcatatcttgaacatctttccatgtcaattatattttttaacatatggatttaccactgttttcttaactaatatgtgttcttaggtacttagggggtctccactttttattataaacaacactgcaatgaacatctttataactagatcatgttgcatctctatcattactttttataagatcaattcctagaagtggaatttgtcagttaatcttccctgaaatgctgagtcaggaagccccaggctttacagttgtcgtgtcaccacaagttaccttcaccacgaaatagagacccagaaaaggcagagaagaccccagggagttgctcctctgctccacaggattcttttagcccccagagagtgaaggatctgtcattcattttttcaccccacgttttgctttataattaaagaaacatgtacaaaaaatgcatgttttaggggccaggaagcaaagagcttcacattcatgctactttatcatcatgcttttataaataagtttctaagtctaaaaagaaaacaaaatatacacacatccccatagaaaaatcttccatgcctgggatataatgtgagcaccagaatggggtgatgtcttagtccattcaggctgctataaaaaaataccacaaacagggtggcttatgaacaacagagatttatttctcacaattctacaggctgagaagtccaagatcaaggcaccagcagatttagtgtctggtgagggcctgctttttcacagatgcgaccttctctctgtgtcttcacatggtggaaggaaaggcctctccagggcctcttacaaggacactagtgccattcatgggggttctacctcgtgacataattacctcccaaaggccccaccataatcacctcgaaaagttccctaataccatgacattgggggttaagatttcaacatattaattttgagggtagggaagacataaacattcagtccattacacagaaagcacacagggcagggtgtgggttaatttaaatggttggctctggctctgtgattctatacactggttctctcatatgtcactgtcaacgacattcatttgcacaacaataaaaatgatatttgacataagaggctttctggaaggttaagtctttacatccatattaggtttatttccaaatattgaaaatgaccatagaataatgttgttatttataaagtctctttctaataattcttatttgaatttttagatcagttcttacagtcattttttctgaaaggacttttacgtctgcagagtcaaatgcgccctctacttaaaaccgcctaccatcctcaaaataataaaaactggacgtaagctgtctgagggcagggccatttctgttttgttcattgcctggagcatagttgatgtctgatgaatatttgtaaagagaaaaaataatgatgcataggtagcatttacagagcacttggcatgtgccaagaaccgtgctaagactgcacatacattatctcatagcagtcccataagggaagggctatcatttcctccaattaaacataatgaaatagaggctgaaaggggtttttaaaaattttctcttggctgggcgtggtggctcatgcctgtaatcctagaactttgggaggccgaggcgggcagatcacgaggtcaggagatggaaaccatcctgggtaacacggtgaaaccccatctctactaagaatacaaaaaattagccaggggtggtggtggacgcctgtagtcccagctactcgggaggctgaggcaggagaatggcgtgaacccaggaggcggagcttgcagtgagccaagatcgcgccactgcactccagcctgggtgatagagcgagactctgtctcaaaaaaaaaaaaagaaaagaaaagaaaatttctcgaagtcagatttttagtatgcagcagagttgaaattacaatcatggtctgaattctaaatatgtactcttaactatgagtctatgaagaagaaattcaaaatactagtaacactcagcaccttaacagaggataatcccaaaaagaagccatagaattgaagattttgagtgctatatgtctatctgtatttccaagagcattatgaaatgaatcatcctcaccaatcattggacaattcattatttcagtcatttcaacaaggcaacaaccaattggcatagtacatttatttttaaaataatcaaggattatgtaaaaattctaaatatatatgagcacctagatatataaagcaaacactattagagctaaagagagaaatgaccctaacgtaataatagctggagaccccactttcagtggggtaataatagctcaacaccccactttcagcattggacagatcatccagacagaatatcaacaaagaaacattggactttatctgcactataaaccaaatggacctgatagatatttatgaacatttcatccaacagctgcagaatacacattcttttttctgtttgtttgttttttgagacaggatctcactctattgcccaggctggagtgcagtaacacaatcacagctcactgcagcctaaatctcctgggctcatgcaagccttcttttttttttttttttttttttttttttttcccctggacagggtctggctctgttgcccaggctggagtgcagtggtgctagctggttcactgcaacctctatctcctgggttcaagtgattctcatgcctcagactaccaagtagctgaggctacaggcatgcaccacatgcctggctaatttttatatttttagtagagacggggtttcaccatgttggccaggctggtcttgaactcctggcctcaaatgatccaccagcctcagcctcccaaagtgttgggattacaggcatgagccaccatgcctggaccccttaagcgaggactgagtagcggggaatataggcatgcctcaccatgcgtggctaatttttgtattttttgtaaaagagatggggtctcaccttgttgcccaggttggtctcaaactcctgggctcaagcaatccacctgcctcagtctcccaaagtgttgggattacaggcatgagccacagcgcctgcccagaatacacattcttctcctcagcccatggattattctcaaggatagaccacaaattaggccacaaaacaagtcttaaaaaattgaaattgtatcaagcatcttctttgaccacaacggaataaaactgtaaatcaataacaagaggagttttggaaactgtacaaccatacggaagctaaacaatatgttcctgaatgaccagtgggtcaataaggaaattttaaaatttcttgaaacaaatgaaaatggaaacataacataccaaaatctatgggatatagcaagaacagtactaagaggaaagtttatagcaataagcaccaacatcaaagaagcagaaaatcatcaaataaacaacctaatgatacctcttaaagtattagaaaagcaagagcaagccaaaatcaaaattccaagaagaaaagaaataataaaaatcagagcagaagttaatgaaattaaaacaaaaaaatacaaaaaatcaacgaaacaaaaagttgattttgtgaaaagataaaagacaaacaaaattgacaaaaccttagccaggctaagaaaaagacaggatccaattaaataaaatcagagatgaaaaaagagacattacaagtgacactgcagaaattcacgggatcattagagactactatgagcaatgatatgccgataaattggtaaacctagaagtggacaaattcctagacacatacaacttaccaagattgaaccatgaagaaatccaaaacctgaatagaccaataacaagtaatgacagtaaagtcgtaattaaaagtttaccaacaaagaaaagcccaggacccagtggcttcactcttgtattctacctaattttttttttttttttgagacagtcttgctctgtcacccaggctggagtgcggtggtgcaatctcagctcactgcaacctctacctcccagattcaagcgattatcctgtctcagcctcctgagtatctgggatttcaggcacccaccaccactcccagctaattttttgtatttttagaagagacgggatttcaccatgttggccaggctgatctcaaattcctgacctcagatgatccacccccatcagcctcccaaagtgctgggattacaggcatgagccaccatgccctgcccctaccaaacatttaaagagggactaaaactaaccctagtcaaactatttcaaaaaaatcaagaaagtgggaatacttccaaactcattctacaagttcagtattatcctgataccaaaaccagacaaagacacaatgaaaaaaaataaaaactgcaggccagtatctctgaggaacatagatgcaaaaatcctcagcacaagactaataaaccaaatttaacaatacactaaaaaaaatcattaatcacgactaaacgggattcatcctagggatgcaaggatgattcaatatacacaaatcaatgaatgtaacacatcatatcaacagaatgaaggacaaaaactatatgattatttaaattgacactgaaaaagcattcaataaaattcaacatttatgataaaactttatgataaaacctctcacaaaatggggtacagaacaacatacctcaacattataaaagccatatctgacagacccatggctaatatcatactgaatggggaaaaactgataggttttcctctaaggtggggaagaagacaaggatatcaacttttaccaccattattcaacatagtactggaactcctagctagaacaattagacagaaaatgaaataaagggcatccaaattggaaaagaagaagttaaattatccttctttgcagacaatatgatcttatatttagaaaaacctaaagactccagcaaaaaactgttaggtctggtaaataaattcagtaaaattgcaggatacaaaatcaacatacaataatgaatagcatttctagatgctaacagtgaacaatctgaaaaagaaaccagggaagtaattccatttataatagctacagataaaataaaatgcctaggaataaacttaaccaaagaaaaaaatctctattatgaaacttacaaaaaacattgataaaaaattaaataagacacacaaaaatggaaaggtattccatgttcatgggctgggagaatcaatattgttaaaatgttcatactatctaaagcagtgtacagatttaatgcaatccctatcaaaatactgatgacagtcttcacagaaatagaaaaagattattaaaatttatatggaatcacaaaagacccagaatagccaaagccaccctgagcaaaaagaacaaacctggaggaattgaattacctgacttcaaattgtactacagagctacagtaatcaaagcagcatggtactgacataaaaacaaacacatagaacaatggaacagaatagagaacccagtaataaatccacacatctatagtgaactcattttttacaaaggtgccaagaacatacactgggaaaaggatagcctcttaaacaaatgatgatggaaaaaaatggatatttaggacagcaatttttaaccacaggcaatttttctccccaggggcacatgtggcaatagttggcaacacgtatggttgtcacaaccggggaaggcacctactggcatctagtggttagaggccagggatgctgctaaacattctacaagagacaatgaaactagacctctagctcttgccatatacataattcaattaaaatggattaaaggcttaaatataagactgatgctatgaaactcctaaaagaaaacattgagtaaactctccaggacattgttctgggcaaagatttcttgagtaatacctcaaaagcacaggcaaccaaagcaaaactagacaagtgggatcacatcaagctaaaaagcttcctcacagcagaggaaacaatcaacaatgtgaagagccaagccacagaatgggagaaaatatttgcaaactactcatctcacaagggattgataaccagaatatacaaagagctcaaacaactctatagaaaaaaatcaaataattatattttaaaaagggcaaaagggcctgggtgcaatggctcaagcctataatctcagcacttagggaggccaaggtgggtggattccttgagcccagacgttcaagactagcctgggcaacatggcaaaagcctgtctctacaaaaatacaaacattagccatgtgtaatggcgtgcgcctatagtcccaggtactagggaggctgaggtgggaggatctcttgagtccgggaggttgaggttgcagtgatccatggtcatatcactgcactccagcctgggcaacaaagcaagactccttctcaaaaataaataggccaggcgtggtggctcacgcctgtaatcccagtattttgggaggccatggcaggcggatcacaaggtcaggagttcgagaccagtctggccaacatagtgaaaccctgtttctactaaaaatacaaaaaattagcaaggtatagtggtgtgcacctgtatctcagctacttgggaggctgaggcaggagaattgcttgaacccagaaggcggaggttgtagtgagccaagatcgcgccattgcactccaacccaggcaacagtgtcagactctgtctcaaattaaataaataaataaataataagtagggcggggcgtggtggctcacgcctgtaatcccagcactttgggaggctgaggcgcgcagattgcgaggtcaggagatcgagaccatcctggctaacatagagaaaccccgtctctaataaaaatacaaaataaaattagccgggcgtggtggcgggcgcctgtagtcccaactactcgggaggctgaggcagaagaatggcgtgaacccgcgagtggaggttgcagtgagccgagatggcgccactgcactgcagcctgggggacagagcgagactctgtctcaaaaataaataaacaaataaataaataaatattaaaagggcaggccggacatggtggctcatgcctgtaatcccaacactttgggaggccgaggcgggcagatcacaaggtgaggagatcgagaccatcctggataacacggtgaaaccccgtctctactaaaaatacaaaaaattagctgggcgtggtggcgggcgcctgtagtcccagctactccggaggctgaggcaggagaatggcgtgaacccgggaggcggagcctgcaatgagctgagatcgcaccactgcactccagcctgggcaagagagggagactcggtctcaaaaaaaaaaaaaaaaaaaaaaaaggcaaaagatctgaatagacatttctcaaaagaagacatagaaatggacaagaagtgtatgaaaaaatgtttaacatcattaaccatcagagaaatgcaaatcaaatctgcaatgagatatcatctcatcccagttaaaatggcttttattcaaaagacaggcaataacaaatgctggcagggatgtggaggaaagggaaccctcgtacactgtcggtgggaatgtaaattagtacagctactgtggagaacagtatggaagttcctcaaaaaactaaaaatagagctaccatacgatccagcaatcccactgctagggatatatccaaaagaaagaaaatcagtatatcgaagaaatatctgcacttccatatttatggcagcactattcacaatagccaagatttggaatctaaatgtccatcagcggatgaatggataaagtaaatgtggcacatatacacaatggaatattattcaaccattaaaaaagaagatcctgtcatttacaacagcatggatggaactggaggacgttacgttaagtgaaacaagccatgcacagaaagacaaattgtgcatattctcatatgtgggagcccacttagcccctggtaatatatattgttaaaattaaaacaatggatctcacggaaatagtagaatgatggttaccagatgctgggaagggtagtgaggataaactggggaaggttaatgggtacaaaaatatagttagatagaataaataattctagaatctggtagtataacaggtgactatggtcaataataacttattgtatatttcaaaacaactaaaagactgaaattggaatgttcctaacacaaagaaatgataaatacttaagtagatggataccccaattaccctgattttattgttacacattgtatgcctgtatcaaaacattacatgtgccccataaatgtatacacctattatacaccaatgatcattaaaaaataaaaaaaaatcaaggtgataaacctaatccttctgaaactcatttggaaggaatgaaagatcaaggaccccaaggttgtgagtacgtacagaagcagtatagtaattggtaggtatgtactgctgcattttccctatgcagtcagtgatacctattggatatctacaaagcatctgtcacaagagacgacagaggagaagtttaacatacttctttaaagaacttcattctggctaggcgcagcggctcgtgcctgtaatcacagctctttggcaggccgaagtgggaggattgcttgaacccaggagttgaggctgcagtgagctatgattgcatgactgcactccagcctaggtggcagagtccctgtctcaaacaaataaacttcattccatttgcacagttaagacaaacacatgtgaagtagtatatatactcgggagctaagtggggcctaaaaaatgtaatttaatcctgtcaaccagcctgtaaggtagggatggctgtccccattatgctattgaggagacaaagcatagagagactaaactagttgcccatgtaacacagttcatgtgtaggagtgtcagggctatacccacattcatctgatcctgaagtccattcacagacccaccagagcttactgcttccaaatcaagaggacacaaacaagggccaaataaaccaggaaacattatatgaagcaatgggacttacgcctgaccttgaaaggcaagcaacagttggacaggcagaaactaaaagatatgacaccataagatgcaggaaagcatgcacaaaagcccaactgtgagatttagcttaatacaagaggactaggagagcagggaggtagtgactgattgatgggatgaagcacaaaaacaggaggaggtgggagcagaggtgacttgaaatcacatggggccagtggcaggtgtgaggagagtttgaacatggtgtgatgggcagtagagaaccatgggacttttaggagcatggaagtgatatcaaaaatcacaatttagtgcagtaattcttaaccacaggcaattttgctccccaggggcacatgtggcaatagctggagacacttatggttgtcacaacaggggaaagcatctagtggtcagaggccagggatgctgctaaacactgtacaatgcacagaacagcccccacaacaaagaattatccacacaaaatgacagtagtaacaaagttgagaaacctggctttaggaagatagtctggcagtggctgccaagatggaacagagagaagaagtcaagagcccaggggagatgttcattcggggagatgctcattcagggagatgggagtgagatgagggaccagaaggggagaatggcaaaccctccaagtatttcaaaggaaaaagaaagatgcaatttctaatccctcttacaggaagttttctacaaaatgtggaaaactgcacttaagactttttctttttttttttttttttttgtgatggagtttcgagcccaggctggggtgcaatggtgtgatctcagctcaccgcaacctcttcctcccaggttcaagcgattctcctgcctcagcctcccaagtagccgggattacagccatgcgccagcttgtccggctaattttgtatttttagtagagatggggtttctctgcgttggtcaggctggtctcaaactcctgaccacaggcccacctcggcctcccaaagtgctgagattacatgcgtgagtcaccatgcctggtcaagacttttttcttttaaatcatctgagggcaccttattttctgatctaaaaaattgtaaataatacacaactccaagaaaatcaccacctcgagagtgtagggcacaaacctttaactattatcagtaacattttctgtctttttgttagaacagaatctgaagcaaatttggcaaaatgttaacatctgttaaatttggatgatgggtacgtggttgtctgtaatattattttctatactttatagatacttgaaaattctcatgattaacaaaaaacagggtgggggaagaaagaaaaagaaagtcttagaggggcagttaataacttatactagaatttttcttggtattttaaaatatcatttgttaaattacagaagttatatgtgaatatgtgttcattgtaaaaaccattcaacaatacaaaaataaaaataaaaaatagaaattcccctttcattctatttctttttctctctccttaggttactactgctacatgttagtgtgtgtgtgtgtgtgtgtgtgtgtgtgtgtgtgtgtgtgtgtattgtgtatatatacacattatactacatatatatgtatatatagtataatacatatattatactatatatgcatatatagcataatacatatattatactatatgcatatatagtataatgtatatgtatatagtatatgtatatatactatacatactattgtatacatatatagtatatatactatatattgtgtgtatgtgatatatatactatatacattaatgtatattatatattatatgtattatactataaacattaatgtatattatatattatatgtattatactataaacatagtataatacatgtattatagtatataatacatgtatatacatagtataaacatgtattatagtatataatacatgtatatacatagtataaacatgtattatagtatataatacatgtatacacatagtataacacatgtattatagtatataatacatgtattatacatagtataatacgtgtattacagtatataatacatgtatacacatagtataatacgtgtattgtagtatataatacatgtatacacatagtatatacgtgtattgtagtatataatacatgtatacacatagtacatacgtgtattgtagtatataatacatgtatacacatagtatatacgtgtattgtagtatataatacatgtatacacatagtatatacgtgtattgtagtatataatacatgtatacacatagtatatacgtgtattgtagtatataatacatgtatacacatagtataaacgtgtattatagtatataatacatgtattatacatagtataacacatgtattatagcatataatacatgtattatacatagtataacacatgtattatagtatataatacatgtgttatacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattatagtatataatacatgtatacacatagtataacacatgtattttatagtatataatacatgtatacacatagtatgacacatgtattttatagtatataatacatgtatacacatagtataatacatgtattatagtatataatacctgtatacacatagtataatacatgtattttatagtatatcatacatgtatacacatagcatatacgtgtattgtagtatataatacacgcatacacatagcatatacgtgtattatagtatataatacacgtatacacgtagtatatacgtgtattgtagtatataatacacgtatacacgtagtatatacgtgtattgtagtatataatacacgtatacacgtagtatatacgtgtattgtagtatataatacacgtatacacgtagcatattacatgtattatagtatataatacaagtatacacatagcatattacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataatacatgtattatgtacataatacacgtatgcacgtagcataataaatgtattatgtacataatacacgtatgcacgtagcataatacatgtattatgtacataatacacgtatgcacgtagcataatacatgtattatgtacataatacacgtatacacgtagtataatacatgtattatagtatattatacatagtataatacatgtattatagtatattatacatagtataatacatgtattatagtatattatacataatataatacatgtattatagtatattatacatagtataatacatagtataatacatgtactatatatatacatgtatagtataatacatgtattatactatatatagtatatattacatatattatactatatatgtatatacagtacacatatacagtataatacatatattatactatatgaagtatatatagtatacatagtataatacatgtattatagtgtacatatatacatatatactatgaacatatatgtatatataatacataatacatatatactatatatgttatatatacacactaacatatatatactaacattagtatattactagtatattaccattagatatatactaatattagtataacattagtgtgtgtgtttatatgtatacacacacattcactaacagtgtgtatacatatgtggtgtgtatatacacacacacactaacattagtgattgtgtatatatattgatatgattcgtctctgtgtccccaccctaaatttcatctagaattgtaatcccaacatgtcgagggagggacctggtgggaggtgactggatcatgggggtggttttccccatgctgttctcatgatagtgagggagttctcatcagatctgatgatttgaaagtggcagtttcccctgcacactctctctcctgccaccatgtaagacatgccttgtttccccttctccttctgccatgattataagtttcttgaggcctccccaaccatgtggaactgtgagtcaattaaacctctttcctttgtaaattactcagtcaggtatactttatagcaatatgaaaatggaacacataaatatagtcacatggaataatatcttatatatgtgtgtgtgtaaatacatatatatgcccctaattattttcctacgcattcgtagaaaggaaagaagggaggaaaggggagaaagggaagaagggagggaagaagagagaaaaagagatttatgagatatctagatagatatctagatagctatctacctatccatctatcttatgagggaccacaacacacaggcaacatgattttcacattaacacattttagagggttgctcttccgtgtcaatttataaagatctacctctttctttttacttcttcagaatatttcatagtgtaaatgtaccataatttgtttactactaagattgctatatatttaggttgattccaatgttttgctatttcaaacaatcctggaacatacaactttgtgttcgtatataagaatttttgtaggggagattcctagaaatacaatttttggatcaaagggtatatacatttctggtgttgatatacagtaagattgtgcccccctgcaaaaaaaccgtgggctcctcatttctctaaaccctcactgatgctgtatgcaatcaacctttaaacatttttccacaattaccaaaactgcatccaaaaactactccacagacatattcacacttatgggaagtcatgaatgtacactgcactgttaatggaaaaatactgaaaaaatatttcaccaatagggaaacatttggacagattgttgtatatctgcacaatgaagttctgtgcatctattaacaaaatagcaaggactcactgtatatatccataggggaagctcttgaaggtagaggaacaaagcaggatgcagagcaatttatacagtgcataaccactagtgtttaaagtggtggtagtaaatatacatgttttactgtatgtacattaaagacagtgtctgggaaattacacaagatattgataacggattgcattgagggaaaaggcacaagagatctgggagaaagaggtggaaagggaactttccacatacattttttatacctattttcatctttatcgttgaaccctttaaatgtactacctattcaaataatttttacagtttgaattcagacattaaaaatctgccaaatggtagatgatgagtgctctcactgctgtttcagagtgcagtttcctaattgctggtgacattgaacttgtttttatgtttattggccatccactccctactcagatgtctttcgcattttgcaactgacttgttgctttctttccagattgctttttagggtttgttttttttttaatatatcaatgcttttttttacagttttattgaggtagattttacataccataaaagtcaaccacataagtgtgccatccagtgatttgtagcaaatgtatagagttgtacaatcatcaccatatatcaagaatattaagccattggttccagagctccttgatgcctcttgattacataatcctttgcagcttagctagaggaaatagttttcccccactgtaacatctgtcttttagtttagactccgatatggacagatgaaaattaatccacctagagaggcttgaacatagacaaaagtgaccaaatacaaggggcaaatgcaagtctcctactgagtctcaagaagaaaaaagaaggtttcactatgcaaacagaccatatgaaatattatttgacagtgtggctaatttcattcataaaaactaaatatgaactgtgggtgtctgagaatatgtagaattcaagaccagcctggccaacatggtaaaacccccatctctacaaaaaatacaaaaaaattagccaggtgtggtggcacccacctgtagtcccagctactagggaagctgaggtggcaggatcaccacctgagcccgggaggttgaggctgtggtgagctgagatggtgccattgcactctagcctgggtgaaagagggagaccctggaaagaaaagaaggaaggaaagaaggaaggagtgaaggaaggaaggaaggaaggaaggaaggaaggaaggaaggaaggaaaagagagaaagaagaaagaaagaaagaaagaaagaaagaaagaaagaaagaaagaaagaaagaaagaaagaaagaaagaaaaagaaatgtgggagggagggaaggaaggaaggaaaagagagagaagaaagaaagaaagaaagaaagagaaaagaaagaaaggtggtagggagggaaggaaggaaggaaggaaaagagagagagaagaaagaaagaaagaaagaaaagaaagaaaggtgggagggagggaaggaaggaaggaagagaaagaaagaaagaaaaagaaagaaagaagaaaagaaaagaaagaactatcagagagcttggagttgggagaagaataataaaacaaaacccatattcctaggttgctaagacttgcacccagatctgtcagcctacagagtccaatgtcataaccatggaactctactgcctcccaagcctgaaagtgctataaaatgactcttgaaattttaaaatctcatatttctatgtagctttcttttcccagatgtgcatgcacaccatttctcttaccaatcagcagtgtgtgtgtgagtgcttgtgtgtgtgtgtgcacctgtatgttttctttttactttctccatgataaatttttccaggttgtctcaataattcaatacacaaatgtcctattctacattttagatattcctgtatccaaatgtattttttataaagcagcttttacctccataggcccaactggaaattttttacattttaaaaccgtaggcaaatgataaacatttcacttgcttcccaactttctctcccatgtggaaacagaagcggatatgtagactgctttcctacatccaagtaaataaagataaaatctctttggaaacgtaccattttgataatgatcttttcctacccaaatttccatatttgaaattctaaagggatctagaaaaacagttccacccaataaacaatgtttgcatagttctctttgctagaactcctttggagataactctggagataagtgtaagtataaattggatttaaaaagcaactgccatgtaaagaaatctgtttctaagagcaactgaaattacaagagtcatgtgaaagagtgctgagaacgccatctttccctaagcccagagtttgtctcttttctgagttatgtatctgttattttgatgcaatttcttctgatctatatgttgtgctactaaggcagctgaagaggtgacaaagtttatttgaactaggcagtggaagcatcaacagacagcttggatcaagtcagaggacacatacgagtagattcaaaagacagtggtaatttagcttaactctagattatctcttacattgaattgccagtgccaactattgcatgggagttatattgctttctttaaatattcataaagccagcaatagctgacactcatggatcttctaaagtagaaaggttcccaaaagaatgtttaaaatataaacttgttaagaaacaaatctaaaggaaaatgtccaaagatatccagcaatttacacttctatgggaaaatggctatcgctggagttgttctctgcgccaggccctttttatatatacttgttatcgtctgcagagcaagtattagtatccatatttagagaggagaaagcagtcccaggaagaaaggctgagttatccaaaggcacacagctgatgacaatcgtgtttatctggtaccaatccctgggctattttttactctactaggcttattaactttctttccagaagactccttctccggaacacttctcagtgacttcttggacttcacaattttgtgttgatttacatcttcatctttctaacaaggaatcagattccctcaataatttcatttcaggctatttgtcatcaagctaacaacaaatgactccctcaggatggagttatgttgatgtgtctactaatcactcccctggtttgcagatcttggttgcattcagtctctggtcacagaagaggcactttcgatctcatatgatagtttgtggagcagggatagaaattatgaaggacatgttctatcctcctgcctctgtcagccaagaagaccttgatcatctgtcatgcatggtaacgttctctacagacctcaggcttggcctcagaatccttctcaatctaacaccccacacaaaccaatccattaaaattgacaagtgagatgaaattcaattgctatcacctatacaggaaaaccttctttatgcctaccagatacagaaacctttcttaattagtaaagtgtcccaaaataataacttccaagtatacagagctagaattcaaattatcttatgaagtcaaaatttaacccataatcaagaagaatttgtaattaaatcagagagctgactaaataggcattaaagtttactttaaatataaccaaagaggcacctagggctatatctcaaaaaaaaaaaaaaaaaaaaaaaaggcagaggtatctggaaacccaaattctttgtctgcttttattgggccttgggtctttagtatatcaaatgcaactcagaatcacccaattaatcaaaggagctgttaaaaatcatctgattatcggccgggcacggtggctcatgcctgtaatcccagcactttgggaggccaaggtgggcggatcacaaggtcaggagttcaagaccagcctgaccaacgtggtgaaaccccgtctctactaaaaatacaaaaattagctgggcacggtggcggacacctgtaatcccagctcctcaggaggctgaggcaggataatcgcttaaacccaggaggtggaggttgcagtgagccaagatcacgccattgcactccagcctgggagacagagtgagactccatctcaaaaaaaaaaaaaaaatcatctgcttatctacagggaacttaaacaaatttacaagaaaaaaaaaacaaacatcaaaaagtgggtactttttgaacagactataaacagacacttctgttcatagtctatgaacagacacttctcaaaagaagacatttatgcggccaacaaacatatgaaaaaaagctcatcatcactggttattagagaaatgcaaatcaaaaccacaatgagataccatctcatgccagttagaatggggatcattaaaaagtctggaaacaacagatggctggcgaggatgtggagaaataagaacgcttttacactgttggtgggagtgtcaattagttcaaccattgtggaagacagtgtggcgattcctcaaggatctagaaccagaaataccatttgacccatgaatcccattactggatatatacccaaaggatttataaatcattctactataaagacacatgcacacatatggcaatagcaaagacttggaaccaacccaaatgcccatcaatgagagactggataaagaaagtgtggcacataaacagcatggaataatatgcagccataaaaaagaatgagttcatgtcctttgcggggacatggatgaagctggaaaccatcatcctcagcaaactaacacaggaacagaaaaccaaacaccgcatgttctcactcataagtgggaactgaacaatgagaacacatggatacagggaggggaacatcacacaccaggggcctgtcgggggtaaggggagggagagcattagggcaaatacctaatgcatgtggggcttaaaacctacatgacatgttgatagatgcagcaaaccaccataggcacatgtatacctatgtgacaaacctgcatattcagcacatatatcccagaattaaagtaaaaattttttttaattgtctgattataaatccagggagatcaaattttctcttctcttgttcaaagccctttttatttttattcattcatgtaacaaaagcttactgagtgccagccctctgccagccacagtgcttgatgctgaggttgccggcaatgaccgtggcagagggtatctctgccctcactgagtgctcagcttagctgtcttcattcatgcatgcatccccgggcagtagcctcctgctggaagctcagccgtggcctaaggggagaggcccctaaacctccagtctcttgctgtagctgctgctccagacagctccgaacggttcctcatacctctttttttaaccacgtggtgcatttaacagccaacctgataaatctaaaggaaaaaagtcccaagcacaaatatgatttttcaagtgttgggaaaagccacattatttcatggagaactccactgtaattccttgaaagctttagttactctaaattgagtgtagcagacacatacttaaatgtttggaaagttttaccttacttaatttctctaatttttttaaagagaaagaaacaagattaagggaaatgggagtatgtgttaaagggtgggaagaagttagagaagtaaatactgagtatttattcccacaagtgaaatgtgaatttttcctttgagctcctcagtggactttggcatagttttgtgacttaggtatttaaaatatttgaatatttaagctatagggtttattgtaaatgaacataacactagaatatgatccctactacactatatactctctataggcagggattgtatccatcctcagcacccaacataatgcctggtgcagaggaggcacttgataaatatttaaggagtcaataaataagcaaacaactgatcgggagactatagaattataattactagatgatgctactttctatatttagcattttccttttacctgtgcatttgatttaagattgcactgctccagtgctttctctatcaatttcaatgtacataaaattttctctggacattacttggcttaggtgatttccttcctggcattttcatgctttgatctggaaaaaaaacttgtctgcagctttgaaggatactataaacctgaaaatacattttaaaatattggttttacatttcaggtctgcaataaataaaagactgatttacaaaatgtagtctaatcttgaagaatatgatggaacaagaaaacttgactaaacccagggctccaatcctaaaggcagatggattccagccacccttctcctaacacgctggccttcagagaaaaaactatggaggcaggaattgtatcaaaatcctcagcctgcacagcctcctgggaagaaggggactgttatggacagaatgttttgtcttgctccgaaattcatatgttgaaatcctaacacacaatgtgatggtatttggaggtagagcctttgggaggtaattgggtcatgagggtgaaatcctcataaatgggattagtgagtgcccttataagaagaaaccagaaagctaactagctctttatctgccatttcatgagaaatgggaagtttacaatccagaagagggccctcagcagaacccaactatgctggcatcctgatctcaaacttccagcctccagaactgtggactatttctgttgtttataagccaccagtctatcgtactttgttatagcagcccaaactgattaagacggggaacaaatggacatctgctggttttgcctgctgagaattcttgctctgttagttaaaagcatcctgactttcctttggatatacagaaaccactgaaagcagttttggtggactgtcaatcatagccctacctagtccagagataaacacatgcaataagcaagaccaataaatgttttcttctaagaatctgaatcatgaactgtaaaacacaaggacagaaaaagattacaacataatcattccaacagtgttcttagtttctgattcctatatttcaggacctgtgtagattcttatcctttgagctacctcatatctttcctttaaatccttgttttgattttgtttttgtgttttatttagattgaccagaatcggttgtttctgctgctcacaaccaaaaaatcctgttcatgctgaaactaaggttccgactactttgaagttgaaagttatcgaaaattatctggtgacttgaggttaagatagagcatggtaagacctactttaaacccaatggcacaatttaaaaaaatagaacatggaagtaacaaaaaaagaagacattttcttatgtgatgagagcaggcgtttcagacctgccatggccccactctgagcccattgatgagctcagggattagggttctttctaccccagattgcttactccacacaaaatgctaggatctccactttagcaggtacttctatggaatgcagaggccatttggaagctatgtcctctcagtgggctctgcatgtgtgtcctttgcattgagtacttgctgattcagtgttataatgaggaaaagaccattttaaaccaagtccaagtcatcttttactccaggatccaagttcagtccactttttgtggcctggcccagcccagggatggctgtaatcaaggtcatagagatgggaagaagggacaaggaggctcccaagagggaatattgtgtggctgggaaggaccatgagtactgacctgtgtaccaggagtcagttggatggaaacttttaaaatagacccagtaggcagctaaatcagaacctgcctcatgcatctctgcttcttagtggtaaacatcaacccacaggaactgacagtatgcaaaaaactaatgagttataaccctcaggcccaccagtccagcaaagagccctgttccttaagtgtaactcggagtgaagatgtgcaccccctggaggggccattgaggcctattttggggttggctgcagcaacagcagcaacaaaagccaccagggcaggcagatcggcccaagccacatctctttcaactacagattaactttccaagtgctggttttgccagcagcagcagcatgaatgagagatcatgaaaagcaggcatatgtggccacttgggtgtcttttcaaatgcacaggttttattaggagatggtgccaggtctctagatctgacaggagcagcaaattctggagcaggcagcatcctggacaatggttgagagtcctcaagcctccaagagacacacataaattgtacacctgagatgagagctctcagaaccaaccctgaagatctggcagctattaagaaaagaaatcctagacagaggaaaaggagtaacagcagacttgaggggaagataaccagtttgtttggtgcactgctgagtttgctgtgtgacgtagaatatatatccctgccaaatctcatgctgaattgtaattcccaatgttgaaggtgggcctggtgggagatgtttgggttataggggtggaaccctcatggcttggtgctgtcctcacaatagtgagtgagtccacacaagatctggttgtttaagtgtgtggcacctcctccccactctctgctcttgctttcgccatgtgatgtgcctgctctggctcctgctttgccttcaccatgagtaaaagctctctgaggcctccccagaagccgagcagatgctagtgccatgcttgtacagcctgcagaaacataagccaattaaatctcttttctttataaattatccagtctcaggtattcctttatagcaatgcaagaatggcctaatgcagaaaattggtaccagggagtaggcattgctataaagatacctgaaaatgtggaagcaactttggaactgggtaatgggaagagtttggatggctcagaagaagacaggaagacaagggaaagtttggaatttttaatagcctggttaaaatcctgatagtgatatggacaataaagtccaggcttacgaggtctcaaatggaaatgaggaattttattgggagctaaagcaaaggtcacccattttatgcttcagccaagaacctggctgcgttctgtttatgccctagggttctatgaaagtttgagcttcagagtgatggttttggatatctggcagaagaaatttctaagtagcaaagcatttgagaagtggcatggcttcttttaataacctatgctcagatttgatagcaaataaatgacttaaagtgggaatttatatttaaagggaaagcagagcataaaatttggaaaatttgcagcctggccatgtggcagagaaagaaaaagctttttcaggagagaaagtcaagcaggctgtagagcaatcatttgctagagaaatttgcataactaaaaatgagccaagtgctaatagccaagacaatggaaaaaaggccttgaaggcatttcagagatctctgaggctgtctctgccattagaggcccttaggcctaggaagactgaatggttttatgggctaggtccccagccccactgccctgtgcagtctttgggacagtgctccctgtgtccctgggacaatgctccctacatccgggcactctggctccaactcagctcaaaggtccccagatacaacttggactcctgcttcaaagggtgcaagccataaaccttggtggcttccacatggcattaagcctgcaggtgcacagagtgcaatagagaagggggcttggcagcctctatctagatttcagaggatgtatgagaaagccaggggtggagtcctcacagagaacctccactagagcagaacagaggggaaatgtagggttgggtgcgccacacagagtccccactgggacactttctagtggagctgtgggaaaggggccaccatcctgcagatcccagaatggtagatccactggcagcttgcaccctgcacctggaaaagccactggcactcaacaatctgtgatggcagctgtgcagattgaaccctgcaaagccacagggatgaagctgcccaaggctggggagcccaacctttgcaccagtgtactctgaatgtgggatatgtagtcaaagaagattattttggagctttaagatttaatgactgccctgttggattttgaacttgcagggtcataggtagaaggaatgcatttccacatgagattttggacttgggacttttgattgagttgatgctggaacaagttaagattttggggggctgttgagaagccatgattgtattttgtaatgtaataaggacatgagatttgaggggccagggacagaattatatagtttgaatatatgtccctgccaaatctcatgttggattgccaatccccaatgttgaaagtagggcctggtgggaggtgtttgggtcataggagcagatcccttgtggcttggtgctgtccttgcaatagtgagttagttctcacaagatctggtattgttgcacctcccacaccttcactctctctttgctttcaccatgcgaagtgcctgctcctgcttcaccttctgctatgagtaaaagccctgaggcctccccagaagctgactagatgctggtaccatgtttgtacaacctgcagaaccatgagccaattaaatctctttttttaataaattgcccagtctctggtatttctttatagtagtgcaagaatggcctattacactgtgtctgcaggatataaaggcagaaatatctacttggtagttgtttctacttggttggagtccaagagaaatgtcaaagctgaagacatgggtataggtaggagtcaaagacatggaactggatggtgtgcaccacagaaaatgcatcaggagaggaaagtgaaaggttaaggaaacttgggtaattccaaaatttaaaaaattataacatgaagaagaaaagagaaggggtgatcaaagatcaggtttctaaatctcagcacaattgatatttgggcccgcataatcctttgtctcagagggctgtccttggcatttgtttagcaacagcactggcctctgctcactagaagcactctcctccctgttttgacaatcaaaaatgcctccagatactcccaaatgcctttgtgggtaaaattgtccctgatcgaaaaccattgatcaaagatctaagaggaaaacaggaaacaaagtgtgtcacagaagccaagggcttgaaaaatagttaacaatgttaaaatcctaagagatattgagtaaaacgagaaccaaaggaaccagtgtttgtccagaaagtcattggtgaaccaatcaaaagcagtttcagtggaacaattaaggaaggacaccagactggctgaatgtccatccaacaaataaacagtaaatgacattcaccagttaaaagggtatttggttgaactaggtgatcattttaaggttccttccaaccctgaaattgtgtcattccaaatggtctccaaggaagatctttcaggatccctcaagccctgggctgctggtggctgctcacaagttgacatgtcaaactagcatgtctctgcttgccttactcaggtcacaggaaataaaaatccaaggggaattgctatgcgatccggacccaatccatgataaaaactaaaatatggttttctttatgtcatcacataaccaactgttaagcaatagaatgtgttagactttaaaggcagttgcgatttacagagaggctgagttcataagtaaagtccaggtttaaggttggtctgaggagaaagggccatggggctgaagttgcccagggtctgctggaagtatgtgagcattgtcaagtgtattagtccattttcacactactataaagatactacccaagactgggtaatttataaaggagagaggtttcattgactcacagttctgcgtggctggcgaggcctcaggaaatttacagtcgtggaaggcaaagaaacagcaagcaccttcttcacaaggcagcaagaaagagagaagagagagtgaagggggaagagacccttataaaaccacctgatcccatgagaactaactactatcatgagaacagcatgagggaaaccacctctgtgatccagtcaccccccaccatgtccctccctcaacatctaggggttacaactggagatgagacttgggtggggacacagagccaaatcataacatccaacacctctagacttgatcctgtgggctggatcagatgaggagagtcctgtctgcagatcaaacccacagtggctggagtgcactaactgtgccatggaatgcctgcatagtaattgaccttcacaattgcagcactcttctcaggcttttgaacaatcaaactaacttctatatgagtaaaaaagaaattaaaagcaaagatcagattttcaaactaattcagaaagaaaggatagcagagattctgtttttaaaatgctgaattgaaggctgggcatggtggctgacatctataatcccaccacttctgggaggatcacttgaggcctggagtttgagaccaacctgggaaacatggcgagacctcatctctacaaaaaaattagctgggtgtggtggcatgtgcttgtagtcccagctacttaggaggctgaggcaggaggatcgactgagcccaggagatcaaggctgtgatgatccgagatggcaccgcactatactccagcctgggcaatagagtgaggccctgactcaaaaaaataaaaataaaaaaataaaaaaaaagcaaaattgagaaacaagaattttattcctggcttagttactaacaaagggtgagtcacctcccttctctgcattcagtttccacacctgaaaaataggggtttgagccaagatgctttttgtttctgaagtagagtcgggggttcctgatgtgtgtttccactgttgaagttcttattacacttcatagtatggcttgtttaattgaatgtcctccaattaacaagtgtagtgacctgttccaccacagtcactacaattcacttgtccaccactgaatcccctgcagcctgcagtccttgacaaatatctgttgaaggaatcgatactcctacctacaaaaggcagctctagggaaaaagttatttggtataaatttcaataccatgagctaggatcagagcctcccatcacactttgcttctttaagtttttataaaagctcagctatgggctacagtaagtggcaacattctaaaatacttcccacacctctgatatggatatcactaccatcctatcttatgacttccaactaaagcaaaattggaagctgcatcccaagtcaactattttaaaagacaaaaaatccaacactgttaattctggtacgttactcacctgccccaatgaggttaacttgccttgggacaccagaaaacgacgcacaagatttaatgggtaaggaatcttactttggagtgacaggaatgttttataaccagatagaggtgatggttgcacaatattggggctgtaattaatgccactgaattgttcccttaaaactgtttaattttatgttatgtgattttcacctcaataaattattaaaaataagaaatatagcacctaaaatatatttttatgtgaatttgctgtttcaaaaaacccactttattaaacatttacttgaatacaaaaatgaattccaaattaaataattccttctggagaaaggcccagaaaaagaatatagagctgcttataactcattgttaatttgcaaatgatgctgaacccttgccatgcttctgcataatgtggttcagtcaagggtttggtaatgagcagttcatttggagccatttttccagaataaaggatgctattcatgaaatgattcctcaagtatttatagttatatgccaatctttattttttagtttatggggagacttctttttgaaaggcttaatttgggacttaagaaatttaaggggcctcaggttgcttctcattgataactgatcattccttctccccatattcaatgtgtttgagtggtgtagtagttttctaaggctgccataacaaaatgctaaagactgggtggtttaaacaacagaaattaattttctcatagtctggagactagaagtccaatatcaaggtgtcggcagatttggtttcccctgaggcctctcttcttggcttgcagatgagcacctttttgctgtgtcttcacatggcctttctcctctgtgctcatcctaattcttcttgtgtccaaatttcctcttcttataaggacgccagtcaggttagattagggcccacctaatggccaaggttaggggttacagcttcaacatataaattttgaagaaacacagttcagcacataacaagcagtatctaaatggacccaccacatattacaaaagtttctaataataatgcaatattaaagtagattcaacctcaacattggcaaagacaagcagcttcatgatgcttttcccgttttgcttctccagccaagaggagaaaaaaagaaatattttaaatagcataaatctgcttttgttttccaagggtctatttttttcttttcctaggcaagtcctagttataaataaaataatcctaatcaagttatcgataattttaatatccttttaattaagtacatgaggtattaaatataaatttaactaaatctgattcccattgggaaatgaatgactactctgaggtgattcacatttgtaaaatggcaatgatactcatctatgtcactggaaacacataaaaataatatacatcaacattgattgtaatctatgaaatgcaacattaatacaaggtgaaattattaataatgccattcagtacaaacaaatgaagaatgatgcaattatataagaaataaatttgtgacagaaaatttctcagttaatttttatgtaagctttgcttttttggcttagttttatttcaagaattattgaatgagtttagaaagagtagtgagttgtaggtatacgccattaagcaagttgctcctttcgttagctaagaaaagaatctggaggtggggggttaggaaggaaagaagctcaaccagattctaatctcgtttttccttctatgtacagatttttttttttttgcatgaatttgcttgaactcaatcagcactccttttgtgaaagaaatgagcggaataaaggggatttgagaattgggcaagtgcctatggcaacacaacattctaaggactgacagtgcacatcaatctgtgctatctgatggcaaatgagagaagctggatgcatgactggagaaaggtggcaatcagcttcaatttgtctgccgtaaataaggattcactttctttcaacagaagttcaaagcttttcatttttatctttcctatctgcataaatgcccaccaaagaaacattagacttagagaagatcctcacaattcgtaatcgctttctctttttctcttgttaggtacatgttgtgaaatcctggaagaaagctgagttgttaacaccaattactttaatcctgatttattattcagctttgcaaatgtcagtccccatatgtctctgcttctacacctaactttgaaggttatacataagataaagatacacatattacaattttcaatgagcaaataattccaatcttacacaaactcttccagagaataaaaaaggagaaataagtcccaagttattttataaacttaatataacctctacatcaaaacaacattaggaatatgtaagaaaagaaaattccaggccaatcaccctcatgcacaccaaaacaagaaccataaatacaatattgataagctaaattttacactacatatcatgaccaagatacagttatctaagaaatgtaaaactggtttaacattcgaaaaacatgttagtgtatttactgacatttctagattaaagaaggaaaaaaccaaatgaccaacccaataggtctggaaaaagtgcttgataaaattaacatgtacaataaaagttttcatccacttcacaatgaaagtgagtttccttaaccttcaaaagggtaactataaaatatctacagcaaatacccttcataatggtgaaatattgagcattcctgttaaaaacaagcagatattggggccaggtgcagtggctcacacctgtaatctcagcgctttgggaggtgtgaccagcctggccaagacggtgaaaccccgtctctactaaaaatacaaaaattagttgggcgcagtggcaggcacctgtaatcccagctgctagggaggctgaggcaggagaatcacttggacccagggcgctgaggttgcagtgagccaagatcgtgccactgcactccagcctgggtgacagagtgagactccgtctcaaaaaaaaaaaaaaaaaaaaaaaaaaaaacaagaagatacaagtcggcctacgatcaccacttctagtttacattatgttagagatcctggtcagcagagtaatatatgaaaaagaaattaaagatactaagattggacaggaaaaaaccacatttttaatttgaaaatgatatacctgcttacacagaaaaccaaaaagaatctattaacaaattactgaaattaatagttataaaatataacttataagtttaaaagcagatacaatagtaataaatagccaatattgtttttaaaagccatactgtttacagaagcaaaagcaactatacggacaccatttgcaaggctaaaaactgtgaggtacattaaaataaatctagcaagagattttcaagactttatgataaaaaaaaagaagactttatgacaaaaattataaaaattttattttttagatacagagcctcactctctcactcaggctggagtgcactggcacaatcagctcactgcagcctcgacctcctgacctccttggctcaagctatcctcctgcctcagcctcttgagtagctggggaccacaggcacgtgccaccatgcctggttaacttttttttgaatttttttgtagagacaaggtctctctatgttgcctgacctgatcttgaactcctggcctccagtgattctcctgcctcagcctcccaaaattctgggattacaggtgtcagccaccatgcctgaccaattaaaaaaatgaaaaaccttattaataatcaggaaaggccaggtgcagtggctcacgcctgtaatcccagcactttggtaggccgaggagggtgaatcacctgaggtcaggagttcaagaccagccttaccaacatggtgaaaccctgtctctactaaaaatataaaaatgaactgggcgtggtggcaggcacctgtaatcccagctactcaggaggctgaggcaggagaatcacttgtacccgagagacagaggttgcagtgagccgagattgcaccatttcactccagcctggacgacagagcgagactcagtctcaaaacaaaccaacaaacaaaacacacacacacacacataataatcaggaaaatgccagttaaagccaatgagataccattacatatcttccagatgggcaagaattacagatctgaagcagaacattttggtgaggatttgaaacaacagaaatgcttttacagtgctcatgggagtgtaattacaaactatttaaaaagtgatttggccctatccggtaaaggtaaggatacatataccctatgagcaggaaatagatatgaaattatttacagcagcatcatttataagaaataaaatgaaaactgccgtgcgcagtggctcacacctgtaatcccagcacttcgagaggccgaggcgggcagatcacgaggtcaggagatcgagaccgtcctggctaacacggtgaaaccccatctctattaaaaatacaaaaaaattagccgggcctggtggcaggcgcctgtagtcccagctacttgggaggctgaggcaggagaacggtgtgaacccgggaggcggagcttgcagtgagccgagatcgagccactgcactccagcctgggcgacaaagcgagacgccgtctcaaaaaacaaacaaacgaacaaacaaacaaccaaagaaaatgaaaactaacagactaaaaaaaccacataaattggccgggtgtggtggctcacgcctctaatcccagctctttgggaggccgaggcgggcggatcacgaggtcaggagctccagaccagccttaccaacatggtgaaaccccgtctctactaaaaacacaaaaattagccgggcgtggtggcgtgcctgtaatcccagctactcaggaggctgaggcaggagaatcgcttgaacccgggaggcggcggttgcagtgagccgacgtcgtgccactgcactccagcctgggagacagagctagattccatctcaaaaaataaaaaaggcaaacaaacgaacaaaaattaataggtaaatggatgtaagtacagcatgttgttataagcactatacagcagtaaaagaacgaactactgctcaaacatcaacttggttgaatctcagaaaccatgtcattgagtgaaaaaagcaaggtacagacgatttcttagaatacgaatccatttatacaaaattcaagagcaaatcaaatactgctaaagatactgaattagttttctagggctgccataacaaaacggattaagcaacacaattttattttctcataaatctggaggctcaaaatttgaatcagcaggcttgatttcttctgaggcttcttttcttggcttataggtggttctcttctctaaatgtcttcacatggtcttccctctgtacacattctgtgtccaaatttcctcttcttaaaaggacaccagtcatattagatcaaggaccacccatgtgacctcattttaacagaattatctcttcaacaaccatatttccaaatacagtcacattctgagatactggaggttaggactccaacatatgaatttggcacaggaacacaattcagcccataacggacgcatgcatatcagtaaaactataatgaaagccaaaaaaaataaaaagaaaagaaaaagaaatttccctatgtagctaatccagaaaagatacacagagtaaaatcctgaacatgtgttaattgtgaaagttccatattagctcatctaattaggaaatgagtgctttaccataatttgacaacacattttaaaatgtgtttgtttcttttgtaaaacatctataacctgaaaaaaagtaattatagatgactagatgataaaatgtttactcttgaattcgcgattcaatctcaaaaatgaatagtatcaaattcttctacttagaaaaaaattaatgtatcaagaaaagagaaataaggacattcatatgataaaatgagacgactttagcttatttctacaatagtaaacccagatgggctcatgcaaacttgaaaaacgatatcctctccactttcctactttacaagctaatggtgtttatacttatagaaaggaacaatagaggaggtgacagttacaaagtgctctcattgtcaatggaaacattatccaagaagatttgaataaagcatctagaaggataaattggattgtttttctcccctttggaactcttgtggatacagtattttgcactctggcacaagaaggaaataaatcttagaaagtaattacaatacattcagcagacatttatacatagcacttaccaagggactcaattaactgagcacctacaatgtgccagggactacatgtgaagccacagcatataaaacttctacatttttctcctgttcaattgaatttaattaggtcaaaaacttctatatagagactgaaagcagatcactggttgcctggggcttagggtaaaagtgtggattggatgtcatttacttttgagattgaatttttgagattgattagcttgcctgttcaacaagcattttatactctagtcatttacacataattactctttttttcaggtgatagttgttccaaaaagaaaaacacttaaatgtagaggaaaatttctgtgataataataatgttctaaaactagatggtggtgaatggtaatgacaaatgacttttcaaaaggattttctccaaatcctatgaattaaaaaatatggcccaatatgatatttaaactttgtactaatactaataattcttgtgtatatcaactttacataaaataggtatttgtgcatgagaagtttttctaaaaaacaattacaaaatttgaccttttttttttttttttttttttttttttgagacagagtctcgctctgtcttccaggctggagtgcagtggcgtgatcttggctcactgcaacctccacctccctggttcaaatgattctcctgcctcacctcccgagtacctgggatcacaggtgcataccatcacaccgggctaatttttgtatttttagcagagacagggttttgccatgtcggccaggctggtctcaaactcctgacttcaagtgatctgccagcctcggattcccaaagtgctaggattacaggtgtgagccactgcaaccagcctgacctgtactttcttgactattttatgtaacagttagtaatatattgctagaatttttaaagctcaagtgaaattgttacatctatgataaacatttaattatatttagtaggcaaattttaaggagtcatatctaattgatgattacagagatatgaaaacatctaccttggctcttaaagtttacacaaattccatataatgattccctacagaaaacagttcacctaaaataaaattcttaaatttgctttaaattatgttttttcttattatttgtcatataatgtgatcattattatattttagaaagctacagcttgataaaatttgatttaatttttactgcaagatttatattcaaccaagggtataacaggttccctccagccacagggccttggcgcatgctgtttgtcttgtttgccatgctcttcattcatccttcagatctcaattcagacatctctacctataggaagtatttccccaggcccctagtttagatcagattcctttattatacactctcttggaggcatttagttcctttagagcagttctttggtttgcaattatataatcattaagttagatgttgaactaagggcaatctcagaccaggtgcagtggctcatgctgtaatttcagcacaaggcaggaggatcacttgatgccaggagttcaagaccagtctagacagcatagtgagattctgtctttacaaaaaaaaattttttttgagataagatctcactttgttgcctaggctggagtgcagtggcaggatcaaagctcactgtagcctcaaccccctcggctcaagatatcctcctgcctctgagtcccaagtagttgggactataggcacatgccaccatgcccggctaatttttgtattctttgtagacctggggttttgccatgttgcccaggctagttttgaactcctgatctcaggccatctgcacacctcagcttcccgaagtgctgggattacaggcatgagccaccgtgcccagcttctataattttttttttttaattagccaagtgcggtggtgcatgccaatagtcctagctcctcaggaggctgaggtgggagaggaccacttgagcccaggagtttgaggttgcaagagctatgattgtgccactgcactccagcctgggcgacagagtgagactcttttaaaaaaaaaaaaaaaaaaaaaaaagtcaatctcccacaatccaaccctccagaggagcagactctgcgtctggtttggcacattattacttatatctctttcttctaacagagcgcctggaacatagcagatacataaaatattcactgaaaaaggaaagaaggaaaagaaaaacaacacactagatggttttcctggaatcatccctttcccagtcctgccaactttactgaagactgaatgctgggtacaaatgtcacaaactcagaaagcaaactaattatgaccacatgccttgaatctggccaattagacctgtcttctcccaagaatttgaatcttaaggggttacttaggctgaaaggggcagatgagaccatcatctcaatggcatgggcccctgagaagatgactgtcagcttttgtgctattgggtcctggacagccactgagacttggttcttcaactttccttaaattctgtaagctactccaaaattttttatttttgcttaaattagccagagttagtttctttggcccacagccaaagaactccaactgttatattttcctatctcttttaccttaatcagatgtaaagatttctatatgcagtatttctcaagactagagatgaatgctatgaatttcagaattgtaactaaaggactgtgctacatttaaccaacacaaatgcttacagtaaatggttgcttcaaaatgctgttttgcattggctcaggccaagcccttctccgactgcccttctagttcatttctagcacatcttttccaaatcctccttcattctctgtctccaagctgtgatgtgtagttctttctacgccaaagaatctttctcaaaattcaatcagctttgttaagtcccatatggaaaactccagtcccatgaacttcttatttatcttgagcttacctacctccatccatcctccctccttcagaccaggcaacctggcacttgtgtgtctcttacggtcttaccttccgggtggttacagctagcattcactgagccagggatggctccaaacactttacatgtgttacttcattaaaccctgacaacagccctaagtgatagagacttctattgcagatcagggcagtgaggctcagagaaggtaactaacttgagtaaggacaggaaaaaatatttgacctggacaacttgactcctgagcaggtacccttaaacaccacgtttgtccgcctcagtgtttttcaaatttctcaatatttttcagatctcactcctctccacttccctccccgttaaaataaaagtctgtcttcatcttgcatcttcctgtggccttcttcccttcactttccagtcttcactgcctccactgtagtctagcttccagccttccagccttctgttctcactaaatctgcccttgctgagatcacaaagaggctccgccaagcaccaggtaccttacacattcaactgtgttgaattcatctactcattcaccaaatggttttgagcacctactctgttccagaaactgtgaaatatgaactgggtatatagtagcgaacaaaacagatggagtccctgccatcacatatctgagatcatcagtgacttcttaccttccaggtacaggagccactttggccacttctcatattttctcctgcttaatctctgcagcattggtcatgccaatcatttcttccttgaaatttggagctgctttggcttccgtgaagcctcttacccctgattctctatttctgggaccatgccttctcacttcctttgataagtttctctttttccatcaaccccttaaatgttggagtttctgagagttctatcatggagcacattaaagtcaatatgcctgaaacaatgttttttctacctcccatccacatctttccatctttattccttgttcttgtgaatggcagcatttgacacccaatctcccactctttttctgccccacgcccttacccaattgtcagaaaatcctcagagttctacctcaatataccccttacctgttaacgctctccttacctctccttggacaaatgcaatggaatctttttttttcttaacagcttcattgagatataattgttataaaatactgttaataccgttaagtatatttttcatctcagacactgtatttttcatctttagaagttcaatttgggtctttaaaatattttctatgtctctatttcactttttttttgagatggagttttgccctgttgcccaggctggaatgccatggcacaatctcagctcactgcaacctccaactccgagttcaagcgattctcctgtctcagactcctgagtagccgggactacaggtgcatgccaccacacccagctaattttgtatttttagtagagacaggatttcgccacgttggccaggctggtcgcaaactcctgacctcaagtcatccgcccacttcagcttcccgaagtgctgggattacaggtgtgaaccactgtgcccgcctctacttcacttttaaaacatttgcaatccagttataataactaatttaatatctttctctgctaattccatctgtgtacgttctcagtcagtttaaattgattgattattcttcttatactgggccataatttcctgcttctttgtagggtaatatttgattggatgacagaaatcacaaattttaccttgtttgggtacaaggtacactttttgtatccctgtaaattttcctgagtctgggatgaagttaaattacttggaaatagtttgatcctttcaggtctagcttttatgacttgttaggcagatctgcagcagtgttcagtctattccaatactgaggcaaaagcttcctgattaatctaccctggattttgggtttctccagtctggctgatgggaggaggtattgttcctggacatgcctgagtaccagctactcttctctctaactcttctgagtggttacatccctggccttacacgcgtgctgcttagcactttgctgaatactgaaggagcgtctgcacatctccaggcttctctgcctttgtgcagctctctcctctgtggtgctctgttctaggaacttgtcttggtctccccaaactctcagcttggtctcctcactcagggagaccgctgggctccacctgggtttcctctccctgcatcagagtctggaaactctctcaaagcagtgcgtagggctgtaggatttgtctatccttcatgtttcctgtttcacaaggatctctgtcttttattgcctgatgtccagtgttttgaaaaccattgctttaggtatattgtttgtttttgttgtttttgttgggaagttaaatccagtcctgtacctccatcttgaccagaagaggaagtcttccaacggaatcctaaccaatcaatcaccttatctcaaacttttgcaatccagttttctcactttatcaaaattttattttttcttaaaatactaatctctttcaaaaaaccagctcctggattcattaattttttgaagggtttttttgtgtctctattcccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagatctggtatgttgtgtctttgttctcgttggtttcaaagaatatctttatttctgccttcatttcgttatgtacccagtagtcattcaggagcaggttgttcagtttccatgtagttgagcagttttgagtgagtttcttaatcctgagttctagtttgattgcactgtggtcggagagacagtttgttataatttctgttcttttacatttgctgaggagagctttacttccaactatgtggtcaattttggaataggtgtggtgtggtgctgaaaaaatgtatattctgttgatttggggtggagagctctgtagatgtctattaggcccgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggaaaaagggctaatatccagaatctacaatgaacacaaacaaatttacaagaaaaaaacaaacaaccccatcaaaaagtgggaaaagatatgaacagacacttctcaaaagaagacatttatgcagccaaaaagcacatgaaaaaatgctcaccgtcactggccatcagagaaatgcaaatcaaaaccacaatgagataccatctcacaccagttagaatggcgatcattaaaaagtcaagaaacaacaggtgctagagaggatgtggagaaataggaacacttttacactgttggtgggactgtaaactagttcaaccattgtggaagtcagtgtggcgattcctcagggatctagaactagaaataccattcgacccagccatcccattactgggtatatacccaaaggactataaatcatgctgctataaagacacatgcacacgtatgtttattgcggcactattcacagtaggaaagacttggaaccaagccaaatgtccaacaatgatagactggattaagaaaatgtggcacatatacaccatggaatactatgcagccataaaaaatgatgagttcatgtcttttgtagggacatggatgaaattggaaatcatcattctcagtaaactatcacaagaacaaaaaaccaaacactgcatattctcattcataggtgggaattgaacaatgagaacacatggacacaggaaggggaacatcacactctggggcctgttgtggggtggggggaggggggagggatagctttaggagatatacctaatgctaattgaagagttaatgggtgcagcacaccagcatggcacatgtatacatatgtaactaacctgcacattgtgcacatgtaccctaaaacttaaagtataataataataaaataaaataaaaagaaaaaaagaaatactaatctcttgttattcccttgcttcaaacttttttatggcacccccatatttttataataaaatttgaactgtaattttaaaaagaaaaaactggatttaacttcatctacggatgccaatttcatcaggaatatttaccttgtactgaccagataccatctaatagtgatattgaagttagacttcagagatagactttttttctttttttttttttttttgagacagagtcttgctctgtcacccaggctggaatgcagtggcacgatcttggctcactgcaacctctgccacccggtttcaagcaattctcctgcctcagcctcccaagtagctgggattacaggtgtgtgccatcatgcctggctaatttttgtatttttactagagacagggtttcagtatcttggccaggctggtcttgaactcctgacctcgtgatccacccgtctcagcctcccaaagtgctgggattacaggcgtgagccaccgcgcccagcccggtagactaatttgactctaccattactcaccgtctgacttaatcaaggtattttacttctctaagcctcagttttgtcttctgtaagatggagaaaatactaatatctacaacagagttttcatttgtttaagaatagtttgagacacttttaaaattcttagttctatgtcaaatataacaagtactcaataaacaggaacttatttcagtttattattactaaaacaatcaatcaattggttattttgttgtctgttcaagaatatcatgattacaatttttgtttctatccagtgaacctctgtagaaataaagttgggggctgggagtggtggctcgcctctgtaatcccaacactttgggaggccaaagcaagaagatcacttgagcccaagagtttgataccaacccaggaaacatagtgagacgctgtctctacaaaaaattagaaaattagcctggcatggtgacatatgcctgtagtcccagctacacaggaggctgagtaggaaggatcacttgatcctgggaggtcaaagctgcagtaagccatgatcatgccacttcatttcagcctgggtgacagggctagaccctatctcaaaaagaaagaaagaaagaaagttagataattcttgctgtgatctattttgttattttgtagtctaggaaaattaatgacactttcaaaaatagatgcattcccttccaacagtacaacataaaatacaaaattaaactgtcacaaaagtcttcccaaaagattgaaaattatatgatttaatacttttaagtatctttctaaagcggcgcattttcaaatatttctaacattgggagaaaagcccatctgctgaatcttctagttgaagcaaggagttttcagttctgttgagcctttcccagggaacgataggaaaggtgggtggacccgaagagaagatggctgtgtccccagtggggaaggagtaaacaaggcctgtcactaatttctgtggaaattcagagtcaataaagctgaacactggtgagcaaaatgagacagaagtggagtttcagaatgggaaagaggaaagaaagaaagaagaaacaatcagggcctaacaaggggcagcatatcggagacacatttttccaaaggctgggaaagaaggatgtctggtgacaggtgtttttccacattctgtagaagggcagagaaagagagagaatacatacaagaggagaataatgagattggcacctggaaatcctcaagaacaggcatctgtagtaatagtgtgaacacattttcacatttaactctccaaaaaccctaaatgccaaattctaatattatccccattttatggggaaagaaactgagacttagagaggccaatgaacttcccccggaccacacagcaaagttagcagcaagtcaggaatttgaatctgggtctatttaatcagagcctgcattcttctccaccttgctgtactactagctcttggtaatgcgaggaaagcaggagattcaaaggaatttaggaaagcagtgggggaatgtgaagaaaaggtactggcaaaacttcatacctctagttcttaagtaaaaatttatttaaatttttctttgtgtgtgttttttttttaagccttggcaaaaatgttatcttataccacagtaataaagcatgagattcttggccaggtgtggtggctcacacctataatcccagcactctgggaggccaaggtgggcagatcacctgaggccaggagtttgagaccagcctggccaacatggtgaaaccccgtctctactaaaaatacaaaaattagccagacatggtaacgcatgcccataatcccagctgctcaggggctgaggcatgagaatagcttgaacccaggaggcgaaggttgcagtgagccaagaccacatcactgcactccagcctgggcaacagagtgagactccatctcaaaaaaaaacaaagaaaagaaaagaaaagaaataaataaataaaatgtgaagattcttaagtaattttatgtaagggggcttatttgcaaaagtcaaacttcaagtactagtttatacaattactcaaatattgtgaaaatctctttggagatgatgattcctatttctgcttaagaattagctttagatttattaaggaagtattttttaataagcttaatataatcagaaaatgtgtctctaagtcttcaggaagagagtcatgattttctagaattttatattttctgtgttaaccatttaaaaccatgattattcaactaaaataaatctcatctgttaaaacgtccatatggtattgttgtatataaagctggacccacactgccatctgctgtgtcaagattaggtttaacatcacccacataaaccgggtttaagaaatgcaaaaaaattatattgaaaacccgtattactttgcttcttggaaaatgaatgcaggggaaaataagtactagcagttatttatttcaacttgtattagcagtgtggggagaaattgtatgtgtttgtgtgttttaacatgacatatttcagggacacaaaaatgaatagagaataatataacaaaatttatgtttccaccatctttactaaaaaatgaatattaccaatgccattgatacttgctgggtttgtctccctggtctcattgtcaccactcccacccaaggaaattaccctcatggttgtcatgtttatcactgggaaagcctttcacaggcaaatatgcacatctaataggtaaatgtgttcaccttttacttctgtgtgctttactaaggttgaccagtgaagaagtttctatgctagcaacttcaccctggaaaattagtggagagagctctattccaaaacagtcctgttattcccaggaggattttttcccaaatttaagattcagagatgcccagatgatctctccttggttgccgctaagtgattggtgttccctttctttggtatgtctatggtaatatgtaaattataagcccccattgtcacattacaggttcatgtggggagaaaagtattctacataaagggaaagctgaagaagagacacagaaatgagagaggatagtaagtatatttggggaagagtaagtagactgtcacagctggagcatcaggggatacgggacataaagatggatttctagggcctacaaaagccactgtgccattgacagaatgaagggaaatggaaccacaagagtcatgttgggaaaggacagtacaatgtagcattgcctctgctgcattcgaggtgattccacacagccatgcgagaactggcagctgcaacaggagactgcataggtgaggagagaagtagaaactgggagtttcagacccacccttacaatccctacagaaataagagttcaagggaggtaagagagaggttgagcagtcagaagtagggcctgggagaagagcaggggccatggatgctagaaaacaaaactggggagtcagtcatgagatgcagcagtatatccctctacaaacgatgaaaatgctcttactgcaattctccccagtatctgaccactctagctaactataacttaaacctctttcttttggtcttatcatgtaactgcccttctaataatgaacctgaatagagacaattccaggaggaaaaatattgagccagagacaccacaccatctgcaatccagttccccatctccttcaacacttttatgtaagaatgaactagtttaagtccagacacggtggctcacgcctgtaatcccagcactttgggaggccaaggtgggaggatcacctgaggtcaggagtttgaggccatcctggctaacacggtgaaaccccatctctactaaaaatacaaaaattagccaggcgtggtggtgggtgcctgtaatcccagctactcaggaggctgaggcaggagaatcacttgaacccaagaggttgcagtaaacagagatcatgccattgccctccagtctgggtgacaagagtgaaactccgtctcaaaaaaaaaataaactactttaaatgtatatcaggcaggctagaaagaaaacagaagatagcgccacagaggagcctgcaaggtctaggttaaaggaccccagagaaagccatctcagatggtattgctaaacagaaatcttagacatattggtgacagactgcatctttctgagtcgggtttctgtgcatgaggtggtatgtgtgtgtgggtggtgcaagaaatgggagacaaggaaagctggagaactccaagccattcaaaactcaaaagcaaatcccataatttgttcatctctatagatttcaattagagctacggtctcaactcttgttgggtactgtactggaaaggaggggtgcttcatggaacaagtacagtcatatgtcccttaatgatgggaatacattctgagaaatgccttttaggtgattttgtcattgtgtgaacatcatagagtgtacttacacaaacttagatgacacagcctgttgcacgcctaggctatcttgtatcactattgctctgaccaccaccgtatatgagggtcgtcgttgactgaaatgtggttatgtggcacatgactgtatatgcattagttgtattattactttaacaaattaccacaaatttagtggctcaaaacaacacaactttattatcttacggttctgtaagtcagaggtctgatgtgggactcaccgggctaaaattaaggtgttgccagggatgaatgtcttttggaggctctagaggagaatccatttccccgctttttccaattcctagaggccacccacagtccttaacttgtggctccccttctccatcttcaaagccaacaatgtagcatctctttgaccctgtttgcattgtcatacctctctctctgaacttctgtttccctctttcatttttaacgatccttgtaattacattgggcccacccaaattatctaggataatctccctattttaaggtgggttgattagcaatcctaaatccatctgcaaccttaattcccctttgccatgtaaggttacatattcacagttttcagggattaggatgtagaatttttggggacaccattattctgtttgctgcaaggtgcttccatgtacattgacctgtcataaacacaattaattggtggcacaattcattttcctcatagataaatgtgttcaccttttacttctgtgtgttttattaagactgaccagagaagtctccttgaaagcaacaattatcctggagagttcatgcagagttctattacaatacctttgctctcaagaagaatttccccaaatttaagagtcaggactgcccagctaacctctccttcattgctgctaagtcttataccaaccatagtgttctcttttctttgatatgtctaagttaatatataaattatgaacttctattgccacattacaggtttagaagtagcatgttcccattttacatgattccttttctagcaggcagttactggtttacggcaatttttatgtatcttctttccaacagatatttacttagagcttcccacgtgttaggctttgggggcaatacagagcaagggcagcatgtccctgctctcagagattatactctagtgggcattcagggacagtcacaaatgctctgtggagggaagtgcagagtacaccctggagtggaagaagggtctaacccagagacggagacagtaagggaggttcccaggaagatgtgacatctcagcaacaaccctgtagaacaagttgctcaggtgaggggcatcctgaggaacagcatttcagcaaacagaaatcactccaggagggcagggattttgtctattttggttatagctttatcccttttgctaaaaacaattctgcggacacattaggcactcaataaaatatgtggaacagatgactatgcaaaggtggaagataggaacaagtgtggctacatttgaggaaatgaaagctcagtgtgttaagagggcagtggtgagaggtgaaatttaaaaggttgaggccgggcacggtggctcatgcctgtaatcccagcgctttgggaggccgaggcgggcggatcacgagatcgggagatcgagaccatcctggctaacacggtgaaaccccgtctctactaaaaatacaaaaaaaaaaaattagctgggcatggcggcgggcgcctgtagtcccagctgctggggaggctgaggcaggagaatggcgtgaacccgggaggcagagcttgcagtgagccgagatcgcgccactgcactccagcctgggcgacagagcgagactccgtctcaaaaaaaaaagaaagaaatttaaaaggtcaagatgggactcatgagattgttaagcccttcgtgctttgtatcaggagcaatagggttttttaattattgggagttttttattttaatagactgttttataagagtgattttaggttcgctgcaaaattaacaggaaatacagagatttcccatatactttctgccccttccccaacctacctctttgtcaacatccccgactagagtagtacatttgttacaatggatgaatttatcaggacaaaccattcttgctcaaagttcatagcttccattagagtttgctcttgctcttgtgcattttacgggtttggatgaaaatgacatgtttattagtccgttttcatacggctataaagaactgcccaacactgggtaatttatcaaagaaagaggtttaattgactcatagttcagcatggctggggaggcctcaggaaacttacaatcacagtgggaggtgacagggaagcaaggtgccctcttcacaagacaacaggaaggaggagggctgagcaaagggggaagagctcctcataaaaccatcagatcttgtgagaactcattcactatcacaagaacagcatgtgggaaactgcccccatgattcaactacctccacctggtctctcccttcacacatgggggttatggggattatgagggtcacaattcaagatgagatttgggtggggacacaatatcaacatgtatccactattacagtatcatacagagtagttttactgccctgaaaatcctctgtgctctggctatttatccctccttcttccaatccctggcaaccactgatctttttactgtctccatagttttgccttttccagaatgccatataatcgaactcatacagtttgtagcctttccaaattggttctttcacttagtaataacaatttacattttctccatgccttttcatgacttggtatcaagctcattttttcttagttctgaataatatttcattgtcaggatgtgccacagtttatgcattcacctactgaaggacatcctggttgttttcaagttttgacaattatgaataaagctgctataaacatccatgtgtaggttttcctgtggacatacattttcaacgcctttggataaataccaaataatgcaattgctgggtcacgcacatggtaggaatatgtttagttctgtaagaaaccacaaatgccaggtacagtggcacatgcctataattccagcactttggaaggccgaggcaggtggatcccttgagctcaggagttcaagatcagctttggcaacatggcaaaagcccatctccacaaaaaaatacaaaaattagctaggcatggtggcacacgcctgtagtcctagctactcaggaggctgaggtgggaggatttcttgagcccagcagttcaagactgcagtgggccaaaatcacgctactgcactccagcctggacaacacagtgagaccctgtctcaacaacgaaaacaaaaaactaaaagaaaatcaccaagatgtcttccaagtggctacaccattttgcattctcaccaacaatgaatgagattgcatcctcaccagcactttgtgttatcagtgatctagagtttgaccattctaataggtgtgtaatagtatttcattgttgtcttattttgcatttcctgatgacatatgacatatagcatcttgcatatggttatttgccatctgtattcagcatctttttaggtgaggcattcatcaaggtctttggctcatttttaaaattgggttgtttatgttcttattgttgagtttaaagatcttttcttatattttgaataacagtcctttatctgatatgtctttggtaaatattctctcttagaatgtggcttatcttttctttctcttatcggtgtcttttacaaaatggaaaattttgattttaatgaagtccagcttatcaattctttctttgatggatcatgcctttggtgttgcatctaaacagttatcatcatatgatgttagctgtgggcttgttaaaaaaaagttatcatcaaacccaaagtcatctagattttctcctatgttttcttctaggagttatacagttctgcattttacatttaggactctgttctatattgagttcatttttgtgaagaatgcaaggtttgggtcagactaatatttttgcatgtggatatccaattgttccagcaccatttgttgaaagataatcttttctcctttgttttggctttactcctttgtcaaagaccggttgactatttatgtgggtctatttctaggcactctgttttattatttatctatttgtttattctttcactaatactacactgttttaattactgtagctttatagtaagtcttgatgtcgggtagtgtcagtcttctgactttgttcatcttcaatattgttttcgctgttctgggtcttttgtctctccatataaactttagattcggtttgttgatatccacaaaataacttgctgggattttgattggcatagtgttgaatctatagatcaagttgggaagaactgacaccttgacaatattgagtcttccaatctataaacacagaatatctctccatttatttagttctttgatttctttcatcagagttttgtaattttcctcatatagattttatacatatattgttagatctatacctaagcatttgatttgatgggatgctaatgtgaatagtattgtttgtttgtttgtttgtttttgtgacggagtctctctctgttgcccaggctggagtgcagtggtgcgatctcggctcactgcaagctccacctcctgggttcaggccattctcccgcctcagcctcctgagtagctgggactacaggcgtctgcaaccacacgcagctaattttttgtatttttagtagagacggggtttcaccgtgttagccaggacagtctcgatctcctgacctcgtgatccgcccgcctcagcctcccaaagtgctgggattataggcgtgagccaccgcgcctgggcagtatcgtgtttttattttcagcttctatttgttcattgctgacatacaggaaagcaattggcttttgtgtattaaccttgcattctgcaatgccactatactcacttattaattccaggaggattttttgtggcttctttcagattttctacatagacaatcatgtcatctgcaaacaaagttttctttctttcttcccagtctgtatacttatttctttttcttgtcttagctaggactaaggctaagtcttaggattagctcagacttccagtgtgatgttgaaaagcagtgataagaagagacattcttgccttgctcttgttcccaatctcagtggaaaagttgcactttttcactgttaagtgtgatattgggctctacaggatttttttaaaaaatagagatagagtctcaccatgttgcccaggctggtctcgaactcctacactcaagcaatcctcctgccttggccttccaaagtgctgcaattacaggcataagccaccacacccggtctctaggagattttttgtagatattgcttatcaagttaaggacgttctcctatattgagagattttaagaagcagagtgaattaagcagattcacattttagaaatcattctggctacaggctcacgcctataatcccagcactttgggagtctgaggtgggaggactacttgaggccaggagtttgagaccagcctgggcaacgtaaacagactctgtctctacaaaaatttttttaaaaattaaccaggcgtagtggtgcatgcctgtagccctagctacttgggaggctgagacaggaggatcatttaagaccaggagttcgaggttacagtgttatgttcgtaccaatgtaggcggcctgggtgacagagcaaaaccctgtctctaaaaaaaaaaaaaaaagaaagaaaagaaaaagaaaaagcaagtgttggggtgaagaaattagaacctcatatacattgctggcagaaatgtaagatgctgcaactgttatgaaaacagtttggcagtttctcgaaaagttaaccatagaattaccatgtgacccagtaattccactcttaggtgtataccaagaaaattgaaaatagggattcaaacagatacttgtacatcagtgttcactacagcattattcacaataactaaaagatggaaacaacccaaatgtctattaatggatgaatgagtaaacgaattgtggtatatatatacatagaatggaatactattcaatcataaacagatatgaagctctgatacatcctacaacatggatgcaccttgaatacattatgttacttgagagaagacacaaaaggacaaatattgtatgattccacttttatgacatgaagtatctataataggcaaattcctagagacagaaataagattagaggtttcttaggattgaggggagaggaaaatgggaagttgttgcttaatgggtacagaatttttatttgggggtactaaaaagcttttggaaaaatatactggcgtattccacaacattgtatcatggaattgtcacttgaaaatggctaaaaatagcaaattttaacacacatattacaacaataaaaaataaaaaagtaaaggtttgtcaggcatttaataattaatacctttcattgtttttgtctggaaagagtgtgtgcaaagatacttaacaaccaaatgtaatgtgtgatccttgatcggctcttgcattttttttttttttttttgagacggagtctcactctgtcgcccaagctgctggaatgcagtggcgcgattggctcttgctttctaaataaaatgcctataagatattcttaggacaagtgggggaaattaaatcgggaagagaattattatgaaattaatgatcttaggtataataattgtactgcggttatgtagcagaacatctattcttaggagatacatgctgcaatgttaaagggttaagtgttacaatgtctgcaatgttaaagggttaagtgttacaatgtctgtaacttacttgcaaatggtgaccccaaaaaggtgtgtgtgtgtgtgtgtgtgtgtgtgtgtgtgtgtgtgtgtgtgtgtgtgtgtgtgtgtgtctgtgtacgcgctttggaaggctacaattgcgagaagcgcaggtctccgccaccgaagctttagactcataagccgggtcaggccaaattccgctgtgcgtaggggaacaaacggcacaaacggggcacaaaaggggaacaaacggcatacgcaaccgtccccgcgggagccccggcccagctcagcgcacccgccagcatgccccaccctgattggtccacttgctcagctcgccggcacccctatatccaattggcgtagcgcttgctgagcggcggcggcaaccgacgtacacaaggggcttgagcgttctgtggagagagtgcgaggtcaggccatgaacttggggtaagcaggggtaagctggggtaagctggggtaagcaaggtggtcgtcagcggagagggaggcatgtgtgtctgggttgtcccttggagtctttactggagaacgttcccaacctgcgccgccgagaggggcagagcccagttctcgggtagaagatcgaggcagatgggtcggcccttagcgactccacagaccttacgttttcacttaatgactagcattaaaactgccagtgatcccctttcggtcccttatttacctcaggatgaggagggaagagaggtgaggaggaaaggagagaaatgacgagacagttagaggaagcgtggcggctcctggggaggactcctggcccatgccccgggttcttcgccaccttgtttttggagtcttgcagaatgttgaaacgcccaaattcgttttaggcccacgaggcggggaaccaggcttctcaagaaatcgatgtagtaccagtgcctaacacctagtaggcgctccttaagtaggggtgaataaataaaaagggctggtgcatggtcttcatcactcgcaagtttgatattttgagaagatgagaagccaccaaactcagacctaactacacatcgttcagcaaatgttattatgttttagaatctggggatatggaaataaataagatagtgtgtcccttaaggagattacagtgcagtgcgtcattgaaggtactttaccattgaagctcttttctttcttggtgacgtttcaccaacataaacacgaactgttcataaccctacaataaggaaagccgtaaaacctattctttccagtgttttacctttaatagttaaggtgaggtaatttgatttcccctacctgagcaacaccgcaaatttcgcattcctaatcagacctttcccagcctctctctcccttgactggcttgctggatttaattttctctctctgaattatggactgtatgtatgggctgccatttttgttctcagtggagttttaggaccttaacagacgttcaagttttgttggcagtggctactgttactttatgcctttgcttctgatatgcacgtataaagcaccatactaaatatcactatgtattatttgaaatattgaaagtggtactctttgctcaagcagttactaaccttgatggcattgttagtagtcatatcgatgctccagcactccatagaatgttttagtcatgagttcattatgaaactaatgaatggcggttaaatatatcttgttcctttaacttatgtgaggagttttggtaacagcattattaaaaaatggtggtatgataacttaatttatagtttaccaataacaaaatgagatttcaggttaatgataacaatgcttgtagtattgaagagtttcaagaattttccccctgtagttgtgggttttatcttggattgcaaacgtttttaattaaaacactggttcgatgtgtacaagattcctgcataaattcaaaataatggatttattgtcaggttcaaatgaacatttctggttatttaaaatgttgcggtttgttaaaaatgagagacaactttctttttttattacagagatggtttaaagcttgaaactgaattactggatggaaaaaccaagctaatattgtctccatatggtatgttgtgttacagaaatctgaaatgttaacttttaaattcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatttgcccacaccaaaggggaaatttaattcacaaattgtagcatgcatttagcattttcctttaaaaggttgcacttgagcttaagggtaattttccttttaaattattttcccttatcagaaatctattgtgcttttttctacaaaatacattatcactttgtttattttaatttttgaggcagagtctcactcttgtcacccaggttggagtgtagtggcataatcatggctgcagatcttcctcctccagcctcctgagtagctgggaccgtgtgcatgagccaccatgcccagctaattttttttatttttagtagagatgggatctcactatgttgcataggctggaattaccatttaaaaaatttttttgaggttgggcatggtggctcatgcctgtaatcccagcactttgggaggccaaggtgggtggatcacctgaggtcaggagttcaaggccagcctggccaacatggtgaaaccccatctttatgaaaaatacaaaaattagatgtggtggcgctagtcccagctacttaggaggctgaggcagaagaatcacttgaaccctggagatggaggttgtagtgagccgagatcgcaccactgcactccagcctgggggacagagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgtttgtaatggttgatttttatcttctccaggctgatttgttatagaagccacatttgtgaagacattttattgtcattttaaccaactcagaacatctgaagatcccctttataggcctataataaacagaattactggtcttggatttttggtaggcctataataaagttactagtcttggacttttgattactagacttttaatcataaaattctatcagctatctaaaggtgttttagaattttttttttaagagtaactactgtgttctcaactgatgttgagcctaaattgtttactgccttaaagcaaattgtttgggtttatccccattgcatttgggacttcaaaatactgatgcaacctaagtttcccttctgtattgattgttttcaagaagtttctcttcccatattgatagaggttacagagatcctcctcatttcttttttgctcttcacagactataaacaccaaaatcagtagtattttcttccttttttgttttgttttttagtttcccaaatttcacagttctgccactagatgttgaattctcttttctgcaagttattcatgaattatctctgcatagtgcttttctttattccttctaatggggtaagctcctgagttactacaacacctacaggtctctttttttttcccccatttcccactggttgaattattgtaatctccatagtttgttctttaaacacagctgaactctatctcattatcatcaagtttaacatatatgtggtcaaagtgctttcctaattctatcaaaatctgtgcatttttcttttctttttttttttcttttttgaggcaggctctctctctttgtccaggctggagtgcagtgggacaattatggctcactgcagcctcgacctcctgggctcaagggatcctcctgcctcagcctcccaagtagctaggactacaggcgcgtgcccacaccaccaggctcagttaattgtttaaaattttttgtacagacgggagtcttcctgtgttgcccaggcttgtctcaaactcctgggctcaagcgatccttccgcctcagcctcccagagtgctaggattataggtgtgagccactgtgcccagcctctcctacatttttatttttcttcaatctgtggtaatgaagtaaacttggttactttcctaatttcttaggtttataggaagagaaatgggaaaatacagataatacagtatcataagtaatttattaaaataatggattctaaaactcttacacttaaaatagtctcaaagattagttgaactataaaacaataaaaaaatttttatgagtacctctgcacgtgagaatcagtgacatactaaaaggtatttgtaatattagtgctaggtagcacattttatatatatatattttgtttgttttagagatgaagtttcgttgttgttgcccaggctggagtgcagtggcacgatctcggttcactgcaacctctgccttctgggttcaagcgattctcttgcctcagcccctcgagtagctgggattacaggagcccaccaccacgcccagctaattttttgtattttttttttttagtagagatggtgttttaccttgttggccaggctggccttgaactcctgacctcaggcaatccacccacctcggcctcccaaagtgctgggattacaggcatgagccattgcaccctggcccacattttatatttaaaaatgttacttttctctgatttgttctggccttgggatcctggccccatataaattgtgaagtgagctgatattaaacaaatccattgaacattgtctttataataataaaaaatggctgggcttggtggctcacgcctgtaatcccagctctttgggaggccaaggcaggtggatcacctgaggtcaggagttcgagaccagcccggctaacatggtgaaaccccgtccctactaaaaatacaaaaactagccaggcttggtggtgggcacctgtaatcccagctactcaggtggctgaggcaggagaattgcttcaaccggggaggtggaggttgcagtgagctgagatcgtgctgttgcactccagcctgggcaacagagtgaaatgctgtgtcaaaaaaaagtagttaaaaaaatttttttaattgaaaaaaaaaaaaaagagataatgtaggtggtataatctaatgacataagattcaaagctggagtatagtggagatgtcctataacaactataataaaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttatagttgtgccatattttaaggttagtgttcagaatattaagaaacctagtttctgtggattttagaaaaaatgttagtacaaaaaactattattatacttattttagaatataggaggctttactcatatttaaaatagttatatgaaacattgtttaaaaacaaattacggtatttccagtgaaaattaaggaaaccttactatgactatttgacttgagttactgaaaaacattgctttcctggccacagcatttactcttcctgttcctcattccatgctaagaaatggcagtactttttttaaaaaacaaggttaacacagatttggaaggaacagtagagtgttacatgctttgtctttcacaagtcctggcattgtattgtgtttttaaaagccttctaatttccactttgggataaggaattgcgaatatgaagacaatagaaatatctaaaattttattaggcaatagtgaaataaataaaaaattaacagttcacatggagaggccccacaaatggtttggggacccattaactcctgaatattcccgtgatactcaagatggaattatttactctcttgttatagattattcttggtaaaatgagggagctggattttgtctttaaggctaaaattctagcaacaacctgcttattaggcataacgagaaatcatatcaacaaagttaaaagcagaatttgcctaatcacgtagactttcatgatttctttctcttcactgggagaactagcacattcaaaagaaatcagaacattttttgagccatcctgtgagccctctaaaacatctgattttgatattatagctgggcatagagacaattcatgaaaaggttttccactgatttcacagctaaataagaaaaataacgtcaaggtaatgagtatttatcaagatatttgtattcccctttaggttgtgatttgtgttataatttttattttatttatttatttattttttgagatggggtctcgctttgtcacccaggctggagtgcagtggcacgatcttggctcactgcaagctctgcctcccgggttcacaccattctcctgcctcagcctcccgagtagctgggactacaggcgcatgccaccacacccggctaacttttttttttttttcttttttttgtatttttagtagagacggggtttcaccgtgttagccaggatgatctcagtctcctgacctcatgatccgcctgcctcagcctcctaaagtgctgggattacaggcatgagccaccacacccagccatataatttttatttttattttttatttattattattatttttttagatggagtctcgctccgttgcccaggctggagtctcgctgcgtcgcccaggctggagtctcgctgcatcgcccaggctggagtgcagtggtgcgatctcggctcactgcaagctccgcctcccaggttcacgccattctcctgcctcagcctcccaagtacctgggactacaggcgcccgccaccacgcccggctaatgttttgtatttttagtagagacggggtttcaccgtgttcgccaggatggtctcgatctcctgacctcgtgatccgcccaccttggcctcccaaagtgctgggattacaggcgtgagccaccgtgcctggccagtttttatttttaaaagcatgctggcaagaggaaatggagatttgttttctgttgttgctcgcttgttttccttatttgatataagaaattgtatggctatggtcatgagcaagccatttaacctctgggcttcagtttcctttgttttgttttgttttgttttgttttgtttttttgagacgacatctggcccagactggagtgcagagtgcagtggcacaatctcagctcactgaaacctccacctcttgggctcaacccatcctcccacctcagtgtcccaaatagctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatataaaaactaaaataaatggccagatggctgacacttgtccaccatgttgaggttacagaaacaataggggttggagcatggcaaaacagattatgggagggggaggagaggcaacctggccagtaaaagtgtttttttgttttgttttgttttgttttttgagatggggtctcgctgtgttgcccaggctggagtacagtggtgtgatctcggctcactgcaagctccacctcccgggttcacgccattctgcctcagcctccccagtagctgggactacaggcacccactaccacgcccggctaatttttttgtatttttagtagagacggggtttcactgtgttagccaggatggtcttgatctcctgacctcatgatccacctgcctcggcctcccaaagtgctaggattacaggcgtgagccaccacgcccggccaaaagtggttttattatgtacatgagacctcaaaggtagtagccttcagagaacagatgacaaatgtttccttcagacctttaaaggtgtcagactcggttaatttatcctagatctggacaggggagaatcctcagagaaagcctggctgcgtcattgcagattttctctacagatgcaaatcttccccacaaaagacagctttgcaaggctacttctgtttgtaggccctctgaacagccatcttgaaatgtgtcaaattaatacattttggggtaaaacactgtagttccctttaaagtatagttatccctcagtatccatgagagactggttcaaggatagtcttcccacttcagggtgccaaaatgcacagatgctcatgtggaatccatggatatggagggcctactgtatatcttttagtatgatattatcaaaagtcgtattttataatatttgacatctagagtagttctctacaaatgcttaagaaacttagtggtttcataatgccttaggtcgtgtctttttgttactctgaagtgtgcaccaaaaacattaatgtcatcagtacattctgcagcccttgtaaggtcaaagatttgtaaacttttcccatttcctggaaatccttttttataatttttgatagcagacatcctatgcgtttaaggatggttttactaaaaactaattgatttcacttttttaaataaccaaaacattctaatgaagaagaatcattgttgtatcagacagtatgtattctagacagaaataagcttattgctttctttcagctttggaccttataacagaaaaatctataatttctgttagagtcttgaaatttcgttagtgactaagaaatatccattacttcttcgactaaacttggagtctgcgtatcacaatctgcaaaacatgtgacgtaacagttgtatttcttaggaatagctatgctaaaggcatgagatgggcttcaccctagttgaaaaacaagaaagtcttgtgaggccatcactaacttggctgggatagatgatttagaaaaagagataagcaagaccagctgagtggctcacatgtaatcccagcactttggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaattttaacccatagttctctacttcagaattctagcttttaattctcttaataataattgaatgaacattacaggaaactagaacctcgtgataattgacaaagtataaaataagttattccaataaaactgctccttattggtaattgtgataataaaattgtaccatacttaactttggttctgattaaattttttcttattctgtgtccctaaaaaattattctccactttgtgagttaatctccttcctaaaaaagagttttgattagatctgtgttggtatctgcattaagaaggtcagatttgtttacatggttctgtttttacagtttttgtacatttttttaaaaaggacattatttacagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaaaaaaaaaagttttttttttgagacggagtttctctcttgttgcccaggctggaatgcagtggcacagtctcagctcactgcaacctacccctcccaggctcaagcgattctcctgcctcagcctcccgagtagctaggactacaggtactcaccaccatggccagctaattttttgtattcttaatagagatggtatttcaccactcaggatggtctcgaactcctggcctcatgtgatctgccagccttgacctcccaaagtgctgggattacaggcatgagccaccgtgcccagcctatttaaaaaaacttgtcatatttttgggttttttgtatgtgtgttttttttaaaaaaagaaacagggtcttgctctgttgctcaggcaggtatgcagtggtgaaaacataattccctgcagccttgaacttctggactgaagggatcctcctgcctctgcctcccaaatggctggtactacaggtgtactccaccatgcccagctaattaaaaaaaattttttttagagacagggtctcactgtgttgctcaggctggtgtcaaacttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaaggagagaatctaagtcctccttatttttagttatcagttaatttttacttgagtgtattatgcttcatttgctatcccttcctccttgtgaacatttacattttagcaaatgtattctgaaaataatgtagtaacctgaagggatgattctcctaaagagatgattctggtggtagaaatttttggcactatggcctaattaggtaaatttcttatagaaacccttcaagttaaattttgtgcatggctgtctgttctgcttcatgtagagctgacttgcctacattgaatacttttgttgtctgttgataattttacattaacaaaaggaatgaaatctgaattgcatttgcccacaatcccaaaagcacattgactgaaaaggcaataaggttgtcttggtagaactcattttggaaaattctgtagctctgggtgataattttaagtgtgtaaagtttagaagttgtatgcagacaccgttaaaagttgtagctaaaactaagttttcatgaagttggtgaggatccgttgttggcttatttacttttcaacatcaggataaaaaatctgtaatactaaaaatgttaaataatttcagttgccaaattttcagttgaaatgtcaatatataatttatttcttaatttgcatggctttttaggtcatttattatctggggataatccataccatgattgttaatgcaagtaaagaaccatttgaggtgacatttaggttttaaaatattttgtatatattttttaatgatagtatttgtcagttgatgaaatgacgaggctcatgaatttggaaaggagaactttatttctcatcagcagttgcaacctgcagcatggccattctgacaggctgggaagcatagccttcggccaaccaggagccagaaacttcaaggtgttggggaagggaacaggaatttatgctgagtgaagtggctgaatatacgtatttaataagcatagaaggagtcatgaatatttatgaaaggagaaacatccatgcacaattgagttttatgccccttcatgggtcccatgtacaaaaaatgtcagcgttagcatgatccaagggtagagttttcagccctctgacatcaaaaagtaaagcagaggacacaaaaaccttttggacagaagcatcaggtggttggttggtatcagtgctgacatcttctgaagggctggtttctgtttagcccttaggctaaatagtggttagccagggagggaggaggtataatgtggtgtgtctgatttccccatccactcatggccaagaactcagttttcaaggcactttggggtccttggccaagagatccattcagttggttgggggacttagaattttacttttattcctcatgtgtatctttttttaaataactaaaaaaaaacaataaagttatttaaaaaatttttggaatcaaaagttgtgggggttgatgatgggagaaggactagaaaacgaaacacatgctatatccaggactggacaaccaagagttaaaagagtatgattattggctcattttttttactatttaaatgcagttttcgctgggtgcagtggctcatgcctgtaattccagcactttgggaggccgaggtgggcggatcacgaggtcatgagattgagaccatcccagccaacgtggtgaaaccccatctctgctaaaaatacaaaaattagctggacatggtggcacgtgcctgtagtcccagctatttgggaggctgaggcaggagaattgcttgaacctgggaggtggaggttgcagtgagctgagatcgtgccactgcactccagcctgggcgacagagcaagactctgtctcaaaaaaaaaaaaaaaatcagtttttatgtatttgtatgcgaatgtggtacaaaattggagagatgttattgagggaaaaggaatttgctgtgtaacaaaaaagccctcttctcaaataccttagagcagttgttttcagaaatcccagctgtagccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaaaaaactttctagatccagaagaaaattaggttgaatgaaaagagggccaatttgaaggtatatcataataagtttgcaaatatcaagaataaggatatacttcttcaagcatttaaatatgagaaaatgacaacaaaaatcaaagtaaccttagttttcttctctgtatatagtatagcaatatttataagggtttaataaatagagctaaaatatttaatgcctagacaagatgttcatttataaagagaacatagacatactcagacctgaataattacataaaatatttctcccaaatatttcttttaatacaaaagttcttaaagatcatttctggatcagaaaaatgggtcaaaattaaaacaatttacaagaattttgtggttagaaagtaatgagtagctgacacaaaagtctctaagacattgtgaaatgaaaagagtaatgcatatactataaccatatctatatttaaagaaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgagaccatcctggccaacatggtgaaaccccatctctacttaaaaaatacaaaaaaattagccgggtgtggtggcgcacgcctgtaatcccagctactcaggaggctgaggcaggggaatggcttgaacctgggaggcaaaggttacagtgagctgagatcacaccactgcactctggcctgggggcagagcaagactctttctcaaaaaaaaaaaaagaaaaaaagaaaactaaagtaatcattagtataattataaagagtatctgccaacatagtttgtacagtaaacatcaagataaatagtaatagcaagataacaagaatcaactctgaaaagtcaaaaatcctttgttaaaaagcagagatatgaaaactccaaagacttgatgcttaaaagagacatacttacaataaaattatacattattaaaaattatgggctggatacagtggctcatgcctataagcccagcactttgggaggccagggcagaagagtagctgccttgagccaagagtttgagaccagcgtgggcaacatagtgagaccctgcctccacaacacaaaaaaactaaaaaattagccgagcatggtgggatgttcctgtagtcctagctattctggaggctgaggtgaaggaattactttagcccaggagttagaggctgcagtgagctatgattatgcttgggccacagagcaagaccctgtctctaaaaagagataagatgccaatatattattactatttgtattggtggttctaggcaatataacaaggaaaataaatttcaagtcctaagaattggagaggaaaaaatgaaagtgtagttattcgtcatgtgtatagaaaccccaaagaatctatagatgaaatattcaaagtaaaaagtgagaattaataatttattaggctataaaagtctcaacaaatttcataggttcacattacatagaatgttatagtggattttattagtttgttctctcattactgtaaagaaatctctggggactgggtaatttataaagaggtttaataggcttacagttttgcagactatacagaaagcatagtggcttctgcttctggggaggccccagggagctttcagtcatggtggaaggcaaaatggaagcaggcatctaacatggcagaaacaggaccaagagagaagtagcagggagggctacacacttttaaacgaccagatcttaccatgaaaaacaatgtggagattccttaaagaactaaaagttaggctgggcgtggtggctcatgcctgtaattccagcactttgggaggcctaggcaggcggattacctgaggtcaggagttcgagaccagcctggctaatatggtgaaaccccgttccctaaaaatacaaaaattagccaggcgtggtagcaggcgcctgtaatcccagctactcaggaggctgaggcaggagaattgcttgaatccaggaggcagaggttgcagtgagccgagatcgcaccactgcactccagcctgtgtgacagagactccgtctcaaaaaataaaagtaaaataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcagtcaatgagtggataaagaaactgtgagatagatatagatatggatatatgatggaatcctactcagccataaaaaggaatgaatgaatagcatttgcagcaacctggatggagttggagagtattattttaagtgaagtaactcaggaatggaaaaccaaacatcttatgttctcactcataagtgggagctaagctatgaggatgcaaaggcataagaatgatacagtggactttgaggacttatggagaaaggctgggagggggctgagggataaaagactacaaattggattcagtctatactgctcgggtgatgcatacaccagaatctcacagatcaccactaaagaacttactcatgtaaccaaataccacctgttcccccaaaacctatagaaataaaaatttttttaaaaagtaattgcagttttacccattactttcaatggcaaaaaccgcaatttacttttgcatcaacctaaaaaataaaaagatctcatgagaacttatcgcaatgatagcaccaagtggggtgatgttaaactatgagaaaccatccctgtgatccagtcatctcccaccaggccctacctccaacactggggattacaattcaacatgagttttgatggggacacagaatcaaaccatataatggaattaagctagatatcagtaacaaatagtaactagaaaattcccaaatgtttgataattaggcagtatacttctgactgaaagagaaattcacattagaaaatatttttaactgagtgataatgaaaatattacatatcaaaatgtaggtttcctgtgctgagagggaaatttttcaccttaaatgcatctcttgaaagactgaaaatcaaggaatagtgacctaaagtattcatctcaagaggttagagaaagaacagcaaaattgaagcccaaggtaggtcaaagtggatattagtaaaactggaaatacctacaataaaattaacaaagccaaaagttaattgtttgaaaagttatttaaattgataagcccctcataaaatcgagatgaattaaaaaggagatattaccagagaatatgacattagaaagagaaggggattttctgaataacttcaccaataagttagagaatttgggcttaaaaatgagcaaattattagaaaaacatagattactaaaattgacacaagaagcagtaaatcagaatggtactatctttattaatgaaattgagcttattactaaaaacccaacaaaataaactccagaaccaaatgtgtttactggtgaattcttcccaacaaaggtagaagtgaaaaccttttaggttgtttataagggtagtaaacctgatacccaaaactaacattttttaataccaaaacccaacaggaaatataagaaagaaaaataaatacaagaaagaataataaatcatgatgagttgggtctattcaatgaatgaaagcaagctaggtttaacattcacaaatcaatgatagtcatcatatttataaaaataataggtaaatttaataaaagtggctagacacaagaattaatgtaccagtgtcattagcacaacattgaaaggatgatctgttaaaaagtaattgatgaatgacctaatcacaagttctgttcttggaaggttaaagttaatattataaaatagagggagaaaatgtttgcagattaatccttgataaaaggacttacatccagcatatatttttaaaaactaaacattcactaattagacaacccaatttttttaattggcagaattttaatagacatggctccaaagaggatatatggcaaataaatacatgagaaacggatttttagccatttgttaaacctctatgggccctctggttccagagggaatttaattaatttttaagttcaaagtaattttgttttttaaaaagtgatttcagctctgtgttttgctgctgttcctcctgtaaggtaatgaatggtctttgtaatccagtgtcccgacatccctaccacccacatgaataccttttctgcgtggccagtagacaaggtcggcaggtggatgttgtcatcttaactggggaatcatgaactggcaagaagggctgttctggcccatggcaaagtcaacactgagtgttctttcccaaagctgcatttttataagactgctttaaggggagaattacatgaaatggaaacaggcatctgtagtggaccatttgaaaagccctttattttcagttgtgacttaaccagctgccatttgtacagcatttgaatcaggagtgagactaagatttcctaacagaataatttgaagactgaaagaattacattaggactctgtaacatcaggaactattttaggggaaggttgtagtgggtttcctatgagttttcacacaaggctgtcatgtgagaataggccatgtgcagtggctctttgggagatcaaggcgggtggatttcttgagcccaggagttcaaggccatcctgggcaacaacatgataaaatcctgtctctacaaaaaaataaaaatagccgggtgtggtggtgtgcatctgtagtcccagctacttgggaatctgaggcaggaggatcacttgagcatgggaggttgaggcagcagtgagccgtgattgtgcactccagcctgggtgacagtgagaccctgcctaaaaaaaaaaaataaaaacacaaaagagaataggctccaaacacgtttaggaaaccagtttttatgtaggggaagtctcaggtcaataatagggagatagagtgaaaaagtcagttagcctgggaaaagaggcttctttctttaactgtatggaggatttagtgagagggaatgctagaagaaggtcaaaacaattgttacagtgtgtcttgtgttatacacaaatatgccttactcaccttcaactaaatgcatgcagtaaaccaaaaggaatgcagttctacctactacctctccccatctcccacccccatgtttttcattcttctaactgaatgcacattgggagagacttgtgaaaaagaatgtaagaataatgtaaagcctttcccagtcaacgacagaaatgaaatgcagttaagtggtagtagctttgtaagacatccttgagtaagaaattaaagactcaactgagagatctaattgttcagttatcttagggttatgaatatagataaaacattttgagtgtttaaggaatttttaagggtaattttaacttttgtctaatccctgaataatttgcaatgccactacactaaaatatggaatcagatctggttacatcaaacttaaacaaatatacagcatccactcttttagcttccctgggtcacactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacctcccgggttcaagtgatttgtgtctcagcctctcaagtagctgggattacagacatgcaccaccacagctggctaattttttttttttttttcagtagagatgagattttgccatgttggccaggggctggccttgaactcctgggctcaagtgatctgcccatgtcagcctcccaacatgctgggattatagtcatgagctgctgcatccagctgaattttgaaagtcttttaattgttttggagaaagaattttctgtttttcattagaaaattcccttcccttacacttagatatcttattatatatctctgatctagtatatttaaaatatgattctgagaatcagaatatatctacttaattctttgaattcaaattcgtttgaagttattgctcctcttacagataaatgcctcagtggattaaatctgtatgttactttggcaagatttgcacatattaagtgattagaaaaagagaactgaactttagatggcttttatggctgttgtttaggaaacagtactgctggagcaccctttcagtgctgtgaaacaagaactgcaaagaaaatggattgaagagttgaataagcaaatagaagatgaccgtcaaagaaaaatagaggaaaaaattatatattcaaaggtaacttatgaggttttgtggctataaaagaaaaaataaaatcaaagtctttaatcaattaaaactagaagtattctgaaactcttgacaagaccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttaggttagtactggtttttttttttttcatcaatttatttctcctgagttctgtttaagatgagaattcattctttgaatagggattgaactagaattatgactaagaaatctaatgcataatggccgggcacggtggctcacgcctgtaatcccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcagagcttgcagtgagctgagattgtgctactgcactccagcctgggcgacagagtgagactccatctcaaaaaaaaaaaagaaatctaatgcataatataagaaaggaggctaaaattaaaattaaaacttcctgtcctgattttagcctaatgctaaagggactttaatatctgcataattcttcaaatcctttgatatatgaatttggcatcattaatgttatgcttagtcagtgagcagacatttgcagagcatctgctacttaacaggcactatgctaagcactgagattatttcttcagttttttttaataccatttcctccagtagccctcctagggttgaagaaaaggcatgtagaacttgacagtacaaatgggagatgggagaaatgcattggaaatttgacatttccacttcacttatataaataatactttcagtatgctgataaaaacttatttctacagtcaccaaactaatgcttcatggattttaaaaattgatatataatgttttatatatttataggatacatatgatattttgttatatatgtagaatgcgtaatgattcagccagagtattctggtatctatcaccttgagtatttatcatttctgtgttgggaacatttcaagtttactagccaatttgaaatatataatacattgttgctgaccatagtcaccttactattgctatcaaacattagaacttattcctttcatctaaccatatgtttgtacccattaacctacctctcttgatcactaccaccctcacacacacccttcccagcctttgatacctatcattccattctttagctcgttgagacctacttttttagctcccacatatgagtgggaacatgtgatgtttatctttatatacctggcttatttcacttaacataatgacgtccagtcccatctgtgttgctgtaaatgacaagattctattctttctttatggccaaatagtatcccattgtgtatataccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggtctcgaccacaaactctataccagtgtcttgaagtgttttccgtatgttttcttctagtaggtttacatttttgggtcatacatttaactatttaatccatcttgaattttttttttttttttttttgaagtggagtctcagactgtcaccctggaatgcagtgacgtgatcagctcactgccgcctccacctcccaggttcaagcaattctccctgctcagcctcctgagtagctgggattacgggtgcatgccaccacacctggctaattttttttttttttttttagtacagatggggtttcaccatgttggccaggctggtcttgaactcctgaccttaaatgatccacctgccttgccctcccaaagtgctaggattacaggcatgagctaccacaccagcccttgaattgttttttgaatatggtgagagatggggctccaatttcattcctctgcatatagatatccaattttccaagcattatttattgaagagtgtgtgctttccccaactatgttcttgacacttttgttgaaaatcagttggctgtaaatacatggatttatttctggattccctattctgttccattgatctatatgtctgtttttataccaataccatgctgttgtggttcctatagtcttgtaatgtattttgaagtcaggtagtgtgatgccttcagctttgttcttttgatccaccttgatttggttattacggctcttttttggtttcatagaaagttttgaattttttctacttctgtgaaaaatgaaggtggtattttgatagagatagcattgaatttgtagattgccttaggcataattcttctgatccatgaacatgggatgtcttgccatttgtttgtatcctctttcgtttatttcatctgttttgtagttttttatgtagaaatgtgtaacccccttggttaaatttattcctagatattttattgttttgtagctattgtaggtgggattgccttctttatttctcagctagtgtatagaaatgctactgatttttgtatgttgattttgtattctgcaactttactgaatttattgatcagatgtgaggtttttgtggagtctaggttttgttttggggtttttttttttttttgagacagagcctcgctctgttgcctaggctggagtgcagtggcgcgatctcatcccactgcaacctctgcctcacaggttcaagcgattctcctgcctcagccttccaagtagctgggactacaggcatgtgccaccgcaccttgtaatttttgtatttttttagtagagatggggtttcgcagtgttggccaggctggtctcgaactcctgacctcaggtgatccacccgccttggcctcccaaagtgctgggatttcaggcatgagccactgtgccagtggagtctagggtttttaagatataagatgataacatcagcaaaggggacgttttgattttagtttgttttgttttgttttgtttgtttgtttgtttgtttgtttgttttgagacagctctgtcacctaggctggacttcagtggcacaatgttggatcactacaacctccaccttctgggttcaagcaattcccatgcctcagccacccaagtagctggaattacaggtgtgtgccaccatgcctgggtaatttttgcataggggactttttattttattttatttattttctattttatttattttatttattttctaatttaggtgccttttatttatcttgcctggttgctctggctaggacttctgttgctatgttgaataagaatggtgaaagtgggcatccttgttttgttttagctcttaggggaaaggctttcagcttttccccattaagtatgatgttagctgtgggtttgtcatatatagtctttattattttaaggtatataccttctgtgcctagtttgttgagagtttttattatttagtgatgttgaattttgtgaaatgttttttcttgtctactgagatgatcatatggtttttgtctttcattctgttgatgtgatgtatcacatttattgatttgtgtatgttgaattctgcctgcatccctgggataaatcccacttaattattgggtattagttttctcatgtgctgttggattgagtttgctagtattttgttgagaatttttgcatctatgttcatcaaaaatagtggcctgtaattttctttgttcttttttgttgtgtccttctctggctttggtatcagggtaatgctggcctcacagaatgagttagggaaaattccctcctctttgatttttttggaatagtttgggaagaattggttagttctttgatagtttggtagaattcattagtgaagttgtctggtcctggactttcctttgttgggagacttttttattaccaattcagtcttattactcattactggtctgttcaggttttctatttcttcctgattcaatcttgatagcttgtgtgtctccaggaatttatccatttcttctagattttctagtttgtctgtgtgtagttgttcataatagcctctgatgatctcttgtatttctgtggtatcagttgtaatttctccttttttattcctgattttatttgggtcttctctcttcggttcttggttagtctatcaagtagcttattggttttgtttatcttttaaaaaatctttgtttctttgatcctttgtattgtgtgtctctattttgtttaattctgctctagtgtttgttatttctttccactaatttggggtttgttcttttctagttccttttaggtacatcattagattgctttttgaaatgtttccacttttttgatataggcacttattgctaaaatttccctcttagcactgcttttgctgtatcccataggttttggtatgttgggtttaaattttcatttttttcaagaatttttttaaattttttccttgactggatgcttgttcagaagcatgtggtttaatttctatttattggtacagttgccagtgttcctctcattattgattactggttttgttccattgtggtttgagaagatacttgatatgaagtcagttttttaaagtttgttaagatttgttttgtgtcctaacatatgatctgtcctggagaataatccttatgctaatgaaaagaatgtgtattctcttaactgttggatgagatgttctgtgtccatgtgttctcatggttcaactcccacttatgagtgagaacgtgcagtgtttggttttctgttcttgtgttagtttgctgagaattatggtttccagcttcatccatgtccctgcaaaggacatgcactcatccttttttatggctgcatagtattccatggtgtatatgtgccacattttctttatcgagtctatcattgatgggcatttgggttggttccaagtctttgctgtagtgctgcaataaacatacatgtgcacttatcttttttttttttttttttgagacagagtcttgctctgtcgccaggctggagtgcagtggtgcaatctcagctcactgcgacctctgcctcccgggttcaagtgattctcctgccccaccctcccaagtagctgggattataggtgcccgccaccgtgcctggctaatttttgtatttttagtacagagagcatttcaccatgttggccaggatggtctcaatctcctgaccccatgatcgggctaccttggcctccaaaagtgctgggattacaggcatgagccaccgcgcccggctgcatgtatctttatagtagaatgatttataatcccttcggtatatacctagtaatgggattgctgggtcgaatggtagttctggttctggatccttgaggaattgccacactgtcttccacaatggttgaactaatttacgctcccaccaacagtgtaaaagcgttcctatttcaccacatcctctccagcatctgttgtttcctgactttttaatgatcgccattctaactggcatgagatggtatctcattgtggttttgatttgcatttctctaatgaccagtgatgatgagcttttctccatatgtttgttggctgcataaatgtcttcttttgagaagtgtctgctcatagtcctttgcctactttttgatggggttgtttttttcttgtaaatttgtttaggttctttgtagattttgaatattagccctttgtcagatgggtagattgcagaaattgtctgccattctgtgggttgcctgttcactctgatgatagtttcttttgctgtgcagaagttctttagtttaattagatcccatttgtcaatttcagcttttgttgccattgcttttggtgttttagtcattttgtccatgcctgtgtcctgaatgatactgcctaggtttacttctagggtttttatggttttaggtcttacgtttaagtctttattccatcttgagttaatttttgtataaggtgtaaggaaggagtccagtttcagttttctgcatatggctagccagttttcccaacaccatttatgaagtaaggaatcctttccccattgcttgtttgtgtcaggtttgtcaaagatcagatggttgtgggtgtgtggtgttatttctgaggcctctcttctgttctattcatctatatatctgttttggtaccagtaccatgctgctttggttattgtaaccttgtagtatagtttgaagtgagacagcatgatgcctccagctttgttctttttggttaggattgtgttggctgtttgggctgttttttgattccataggaaatttaaagtagttttttccaattctgtgaagaaagtgagtggtagcttgatggggatagcattgaatctgtacattactttgggcaatatggtcattttcacaatattaattcttcctatccatgagtatggagtgtttttccatttgtttgtgtcctcttttatttccttgagcagtggtttgtagttctccttaaagaggtccttcacgtcccttgtaagttgtattcctaggtattttattctcttagtagcagttgtgaatgggagttcactcatgatttggctgtttgtctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagagacaacttaacttcctcttttcctatttgaataccctttatttctttctcatgcctgattgccttggccagaacttccaatactatgttgaataggagtggagagagagggcatccttgccttttgccgtttttcaagggaatgcttccagtttttgcccattcagtatgatattggctgtgggtttgtcataagtagctcttattatttttagatacgttccatcaatacctagtttattgagagtttttagcatgaagggatgttgaattttgttgaaggctttttgtgcaactattgagataatcatgtggtttttgtcattggttctgtttatgtgaatagattacgtttactgatttccatatgatgaaccagccttgcatcccagatatgaagccaacttgatcgtgctggataagctttttgatgtgctgctggatttgatttgacagtattttgttgaggatttttgcatcaatgttcatcagggatattggcctgaaattctctttttttgttgttgttgtgtctctgccaggttttggtatcaggatgatgttggtctcataaaattaattagggaggattccctctatttctattgattggaatagtttcagaaggaatggtaccagctcctctttgtacctctggtagaattctgctgtgaatccgtctggtcctggacttcttttggttggtaggctattaattattgcctcaatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgttttacttccaattgtgtggttaattttagaataagtgtgattaagtcctcagaagaatgtagattctgttgatttggggtggagagttctgtagatgtctattaggtctgcttggtccagagctgagttcaagtcctgaatatccttgttaattttctgtctcattgatctgtctgatattgacagtgggatgttaaagtctcccattatcattgtgtgggagtctaagtctctttgtaggtctctaaggacttgctttatgaatctgggtgcttctgttttgggtacatatatatttaggatagttagctcttcttgttgcattgatccctttaccattatgtaatggccttctttgtctcttttgatctttgttggtttaaagtctgttttatcagagactaggattgcttttctttctctccgtttgattggtaaatactccttcatccctttattttgagcctatgtgtgtctctgcgtgtgagatgggtctcctgaatacagcacactgttgggtcttgattctttatccagtttgccagtctgtgtcttttaattgggacatttagcccatttacatttaaggtttatattgttatgtgtgaatttgatcctgtcattatgatgctagctggttattttgctcattagttgatgcagtttcttcatagtgtcgatggtctttacaatttggtatgtttttgcagtgggtggtaccagttgttcctttccatgtttagtgcttccttcaggacctcttgtaaggcaggcctggtggtgacaaaatctctcagaatttccttgtctataaaggattttatttctcctttgcttatgaaactgagtttggctggatatgaaattccgggttgaaaattcttttttttttttaagaatgttgaatattggccccaactctctcctggctcgtagagtttctgcagagagatccgctgttagtctgatgggcttccctttgtgggtaacccgacctttctctctggctgcccttaacattttttcctccatttcagtcttggtgaatctgatgattatgtgtctttgggttgctcttctccaggagtatctttgcatttcctgaatttgaatgttggcctgtcttgctaggttggggaagttctcctggataatatcctgaagagtgttttccaacttggttccattctccctgtcactttcaggtacactaatcaaacgtagatttggtcttttcacatactcccacatttcttggaggctgtgtttgttctttttcattcttttttttctaatcttgtctttttgctgtatttcattaagttgatcttcaatcactgataccctttcttacgcttaatcagtttggctattgatacttgtgtatgcttcacaaggttcttgtgctgtgtttttcagctccgtcaggtcatttatgttcttctctaaacggttattctagttagcaatttgtctaaccttttttcaaggttcttagcttccttgcattgggttagaacaggctcctttagctcggaggagtttgttattacctaccttctgaagccttcttctgtcaattcgtaaaactcattctctgtccagttttgttcccttgctggcaaggacttgtgatcctttggaggagaagaggcgttctggtttttggaattttcagtctttttgtgctggtttctccccatcttcatggatttatctacctttggtctttgatcttggtgacctttggatggggtctctgagtggacatcctttttgttgttgatgctaatcctttctgtttgttagttttccttctaatagtcaggcccctctgctgcaggtctgctggagtttgctggaggtccattccatatcctgtttgcctgggtatcaccagcagaggctgcagaacagcaaagattgctgcttgttccttcctctggaagcttcgtcccagaggggcacccgtcacatgccagccagagctctcctgtatgaagtgtctgtcagcccctactaggaagtgtctcctagtcaggatacatgggtgtcagggacccacttgaggaggcagtctgacccttagtagagctcgaatgctgtgctgggcgatccactgctctcttcagagccatcaggcagggacgtttaagtctgctgaagctgcacccacagccaccccttccccctggtgctctgcctcagagaggtaggggttttatctataagcccctgactggggctgctgcctttttttcagagattccctgtccaaagaggaggaatctagagaggcaatctggccacagcagccttgctgagctgcggtgggctctgcccagttcgatcttccaggccgctttgtttacactatgagggtagaaccacctactcaagcctcagcagtggtgggtgcccctcaccccaccaagcttgagagtcccaggtcaacctcagactgttgtgctggcagggagaatttcaagtcagtggatcatagcttgctgagctccctggggataggaccctccgagcctgactacttgcaaggctccctggcttccgccccctttccaggagagtgaacagttctgtctcactggcattccaggcaccactggggtatggaaaaaaaactcctacagttagctcggtgtctgcacaaacggccgcccagttttgtgcttgaaatccaggccctggtggcataggcaccagagggaatctcctggtctgcgggtggcgaagactgtgggaaaagcacagtatctgggccagagtgcaccattcctcacagcatggcacatccctcatggattcccttgggtagggaagagatttccctgaccctttgcactttctgggttgaggtggcgcctcaccctgcttcggctcgctctctgtgggctgcacccactgtccaaccagtcccaatgagatgaactaggtacctaagttggaaatgcagaaatcacccgccttctgtgtcgatcttgctgggagctacagaccggagctcttcctattcggccatcttgccaacaaccctccatcttctagaatttttatagtttcaggtcttaggtttaagccctgaatccatcttgagttgatttttgtataaggtgagagatgaggatccagtttcattctcctatatgtggctagccaattattccaacaccatttgttgaaaagggtgtcctttccccacttcatgtttttgtttgctttgtcgaagatcagttggctgtaagtatttgggtttatttctgggttctctgttctgttccattggtctatgtgcctatttttatatgagtaccatgctgttttggtgactgcggccttatagtatagtttgaaatcaggtaatatgatgcctccagatttgttctttttgcttagtcttgctgtggctatgtgggctcttttttggttccatatgaagtttagaattgttttttctaactctgtgaagaatgatggtggtattttgatggggattatgttgaatttgtagattgcttttggcagtatggtcattttcacaatgttgattctacccatccatgagcatgggatgtgtttccatttgtttgtgtaatctgtgatttctttcagcagcgttttgtagttttccttatagaggtctttcgactcctttgttaggtatattcctaagtattttatatatttttttgcagttgtgaaagggcttgagttcttgatttctctgcttggtcgctgttggtatatagaagagctactgatttgtgtccattaatcttgtatctggaaactttgcagaattattttatcagttctaggagctttctggaggagtcttacagactcctaaggtaaacagttatattgtcagcaaacagggacagtttgacttcctctttactgatttggatgccctttatttatttctgttgtctgattgttctggctgggacttccagtactacgttgaagaggagtgatgagagtgggcatccttgtcttgttcctgttctcagagggaatgctttcaacttttccccattcagtattatgttggctgtgggtttgtcatagattgcttttattacattaaggtatgtcccttgtatgctgattttgctgagggttttgatcataaaggatgctggattttgtctaatgctttttctgcatctattgagatgatcatgtgatttttgttcttaattctgtttatgtggtatattacatttattgagtatgttaaaccatccctgcatccctggtatgaaacccacttgatcatggtggattatctttttgatatgttgttagattcagttagctagtattttgttaaggattttagcatctatgttcatcaaagatattggtctgtagttttcttttttgggtgtgtcctttcctggttttggtattagggtgatgctggcttcatagaatgaattagggagggttccttctttctccatcttgtggaatagcgtcaaaagaattggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaattacaagtttgggagctacagtgttaggtgcatatatgtttaggattgtgatgttctcctgttggaccaggccttttactattatgtaatgtccctctttgtctcttttaaccactgttgctttaaagtttgttttgtctgatataagaatagctatcctgtttgcttttggtgtgcatttgcatgaaatgtgtttttccgctcacataaacttaaagtttaggtgagtctcctaagagggcagatggttggtaagttcttatccattctgcagttctgtatcttttaagtggagcctttaggccatttacattcaatgttaatattgaaatgtgaggtactgttgcattcatcatgctgtttgttgcttgcgtactttggatttgttttttgtttttgttttttaacttgtatttttgttttataggtcctcctgtgtgatttatgttttaaagagattctgttttgatgtgtttccaggatttgtttcaagatttagagctccttttagcagttcttttagtggtggcttggtaatggcgaattctctcagcatttgtctgaaaatgactatatgatgcttagttttgccaaatacaaaatttggctgataatttttttgtttgaggaggctgaagatagggccccaatctcttctagcttgtagggtttctgctgagaaatctgctgttaatctgataggttttcctttataggttacctggtgcttctgtctcacagctcttaagattctttccttcgtcttcactttggataacctgatgacactgtgcctaggcagagatctttttgtgttgaatttcccaggtgttctttgtgcttcttgtgtatgcatgtctaggtctttagcaaggccagggaagttttcctcaattattcccctaaatatgttttgcaagcttttagaattgtcttctccctcaggaacaccaattattcttaggtttggtcatccgagctctgaatttctttcttctacttgttcaattctattgctgagactttccagagcatttcatatttctaaaagtgtgtccactttctttgagctctaaatttctttcttctccttgttcaattctgttgctgagacttaccagagcatttcacatttctaaaagtgtgtccaaagtttcctgaatttttggttttttctttaagctatctatttcactgaatatttctccctttacttcttgtatcatttttctgatttccttgcattgggcttcgcctttctctggtccctctctgattagcataataactaacctcctgaattctttttcaggtaaatcagggatttctttttggtttagatccattgctggtgaagtagtgtgatttttgggggggtgttgacgagccttgttttattatattaccacagttggttttctggttccttcttatttgggtaggctctgtcagagggattgtctagggctgaagagtgttgttcagatttttttgtcccacagggtgttccctatgtattacgcttcccccttttcctgtggatgttgcttcctgtgagcctaactgcagtgattattgtctgtcttctgggtccagccacccagtgagtctacttggctccgggctggtgctgggagttgtctgcacagagtgcttatgtgaactgtctgtggctctctcagccgtggataccagtgcctgttctggtggaggtggtggaggatgcagtggactccgtgggactccttagctttgatggtttaatgctctatttttgtgctggttggcctcctgccaggaggtggtgctttccagaaagcatcagctgtagtagtgtgtggagagggaccagccatggtgagggccctagaactctcaagattatatgtcttttgtcttccgataccagggtggatagagaaggaccaccaggtgggggcggggctaggtgtgtctgaggtcaggctctccttgggtgggtcttgctgtggctgctgtgggggacggggatgagattcccaggtcactggagtagtgtacctaggaggattatggctgcctgtgctgagtcatgcaggttgtcagggaagtgggggaaagccagcagtcacaggcctcacccaactcccccacaaaccaaagggccagtctcactgtgtcccccgaccccctcaaacgcctgcaacatcccccgagtctgtttccaggtatagggcccagctatgaaagaagacctccccagctgcgaaagaaaacggctttagttcttcccccacctgtggagtctgcaagcccaattcatgcccaccccccaccccccacgcccagttctggcaaggaagcttctcgtcctgttcaagttgttacaaagttcatctagagaagtaattctccctgtggagttttaacccctgctcctctggccaccctcctgatggatccctgtggtgccaggcagggatgggatccttggggatcccacgagctcccagtgtctttctgctacttcctctacccatgtatttcactgggctcggctctctaacttgactcagccccaggtaaagtcgggagcttctcccgcaaagactttcagcttctccagtgggggtgtgtgttcgggagaggagggtctccctttcccacttccacagttgggtcactcacagtatttggggtgtctcccagctcctgcagcagcagtctgctttcttcagagggtcctctaaggattgctggtctgttcttgcagttgatctatagctaaaattcacaatgcaagcctccacatgctgctgtgtctggagctgcaatctagtcctgcctcccatctgccatggtcctcaactcctatttccttgcttttttacatattctgcaccttgatatctgcatatctggtataacgatcacttcttccgattttttgaatttgctttcatatctatgatggtggttgggtaggcactttggctttgattctgggtatgtgcagtagtgtaatctctatagacttttttttggccgaaaacagtatctgtggtatctgtaatttccttggtggcttagggtgcagttgttcgtggaggctgtggtaaagttttgttgtgaacggggacaccaaatggaccagtcgttaggttgcaggatgctagcagtaggctgagcatgcctgtccttgggccccagggctgtatacactggcatcagtggtagcaggtcaagccaggccaattattgggcttctagatggcttgctcaggtgctgagaatggtgacagtgggttgggtgggtgagtaggttttcaagccactgggcagcaaacatgggcaatggcagtagtagtagtgggacaaccctctgggatccaagcagccagtggtggtgttggcggtggctataatgggctgcgtgggccagtccccagacttgcaggtggcatatgagggtgggtgccagctgtgatggtaatggcaggttgattgggcccatactctaggaggagtgctcaggtgccaatggtggtgtcctgggcagggcagtccccaggtccctggaccaatgtgcttggttactggtggagatgcagcaaggctgggcagacctgcccccgggttcccaaggtgttgtgtgcagtgctggctgttgtaggcaggggtgggatgatttcccaggccaccagcagaatgcttaggttggggcagtagcagctgcattgtagctctgctactagggagggtgggtttgctttcagtgggttgctcttgcagatggtgaatgtcagtggggctctagggatgtggagatgcaggggctgttgggccccagagcaagatgcaggaccactagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaagctatgtatggaaatgtcagaccttcacataaagttagcaaagagagaagcttgagaaagttttattatttcacatgatatagttctcaaatgttatattggtttggctttttctgttgaggaggtcaagatgaattattacagcacaaagcaaattacctatgtgcttcatttttatctactcctagtttttttgcttcatttctaagcaataattattatatcaataattattctaggtatgttaagagaaatgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgccttcagatgactctcccaccttggcctcccaaagtgttgggattacaggtgtgagtcactgcacccagcctaaatgattgcctatttttaataccttcaatatacctactattcttgtaggaatatcagactttaaactagtataattttataaataggaatgcttaatttatgtggaaaattgcaataaaagcagaactaaaggttaaaatgtgttaatgttaaaataataggtaaaatgtgtactttttgtgtctatttttaccgagaacaattattaaatgatctccctaaattcagtaactgataggaatgtgggtactttttgtaagaaaatttttattgcagtgttcattctgattaagtgaaaattattgtatttagttgctgctatacataatttttattaatattccttaagtgttgttttatcaggtgatttctctttgccagttgatacaatacaaatggaatataatgcatctaacatttcaaattcaagacatgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggttcggttttgttgaaaattaatgaaagaaaaaagtcttagagggcaataattgtttaatgttttggggaaaattatttaatattgaaaattttgtttacaatttttaaaaatcatttgcaacttttttttagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaaaactatatctattccattgctcagtcagtacctgttattcaaatattaccctcagactatttcaacaagtagccctaaaaatatttgtggggacatgtgaagatgctatatattcctttctgcatttatctatccatattttaggaagaagagcctctgaatattcattcattcagcaaggaaaggtaagtatgcatcagattaattccgcagctacttaatgctttctatgtgggacaaaaaagggattcaagatctggacagcatcatatggtatatgtagagaacaatcagaaagggtgtggcttccaggtgagggttagaggtttaagggatagtgtggcactttagcaggagcttgaaggcccaagttggactgggcctaggcaggaatgtagataacatttacttttatctctagacttaactaagtgattttgatattccaggtatgtcattagcagaataggcattctgctttgggaggagggatggctgggggctgtgaatgggaagaaatgactgataaggacaatgagaaattcagtcagttaatgagagatttagaaccattagaatttttattctttgtgcatgaaccagctggtttagttgtctcagaatggggctctaaaaacaagtttcattcaaatggtgagtacattattgtatggtgaattatctaaggagaaacagtaggctcagattaaccaagccagcactgttcctcaggatctaggaattaaatttctcccttgtgctacagtacacataccatagctagtgctagtaaaaacataaatgaataccattctcttccccggttttatggaacaatattatagagttcaggcttctatgcatacattcccaaaggtgttacaggtacatttagaataaagtgaaatgggccaggcatgtggctcacgcctgtaatcccagcactttgggaggccgaggcaggtggatccacctgaggtcaggagttcaagaccagcctggccaacttggtgaaccccgtctctactaaaaatacagaaactagctgggcactgtggcgtgcgcctgtaatcccagctacttgggaggctgaagcaggagagttgcagtgagctgagatcgcgccactgcactccagcctgggcaacagagcgagacttcatctcataaataaagtgaaatgtgattaaagagatatacttaatctaaatacacaattttttactattttttttttaaataggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacactgccgtctttgagtagttctttccagtacgaaatcatcagacagttctaaaattaagacaagtttattgagtaaaaaaatgcatacattggaacggcaaaacatcaataaggccctaaaacaaaaaatacagttatgctttaacaaattcttagcaatgtggcccacgctttttaaaaaattgacgtgttggcagtgtttgttagaacattgacgtacatcccaaatagtaataaattcagtatgaaattatacgcataaccttactcaccatactactttttctcccaaactattgtgacttctttttgctctctgattaaaacaaacaggtaacatccttacacctttgctccatcccttgggctttaaaaagaatggctgtagttagttttgattcactatatactctctgtacttgaggaagagtaagctgtgtttaaaagtgcccttttccatgtcgtcatgtaccaataccctctgcatttcaaaatgttgactcagatgtttttccctctacagaactagaaaattgtccccccactttggtctatttactcatttgaagacaaacagggttactaagagttttacataagttatttctttagagtgacgaagtgttagtttacttcttgcttagtggagacaaaaattgtgagataaagaggaaggaataggatgtacacatttacccatcaatatagcacccagtgttatttcagcaggacccttctgttagcatctaaggtaaggttaggacagtcaagataaaatactggatgttggccaggagcagtggctcaagcctgtaatcccagcactttgggaggctgaggcaggcagatcatgaggtcaggagatcaagaccatcctggctaacacagtgaaaccctgtctctactaaaaatacaaaaagttagttagttagttagccaggcgtggtggtgggtgcctgtagtcccagccattcgggaggttgaggcaggagaatggtgtgaacctgggaggcagagcttgcagtgagattgcaccactgtactccagcttgggcgacagagcgagactccatctccaaaaaaaaacaaaacaacaacaacaaaaaaaaaacactgtatgttaagggagactccttcagtatctaagagcacttgggggtggactgggggagaagggatgacttcatttacccccatagttatggagtcttgagttctaagaaaattttcatccctattgatttttatgctaaaaacagaatcttacaaatgtgatagctatatatccaaatgaggtggtctagtacaagcatttctgaaaaaatttttgaatgacaaaattttatcctaagcgatatgttttccaagtgaatataattctagtttaacacaacattgcaagtcaggtgtgcacattttactaacaaacatatatcaatgtgatttcagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaaaaaaaaaaaaaaaaaaaccggttcttctgctctgtcaccacctgggtattgaagccctataaaaacactttctacttaccttaatatagtctggcgttgctgggacctcacagtgttctttcacactttttatgtaacttaggaactgaaataccactcatgcatttgttctaaagtgccaaagttctgtctaacttattaacacgtctagacccataactccataacttttactgaaataacacaaattcagtttaggctccttctctaaatcctgacatttatttgcactatgacatttatttgtagaaattgcaattttcaaaaacatttttaaaagttagcattagtaacaagttagtaattagtattagaggcagtagttaggaatagatacgggtttgaaagctatctccactgtatctgtctagtatagcattaatgtgttcaacaaatggtaattactactaagaccacctcaaaaatatattcccattatacttccattttgctaaaactaatttaaaaatcaaattgttcaacgcctttgataaacagaagcctatcttttgaaataaaaaatttaatttcattaaatcaaggattgcgcaggtactgaaaattatccaatactctcaaaaagttaccagaattttagcaataggcagtttttacatgactaagcctagagataaaaaatgtgtcctatgtacatagtttattatctaaatgaaactgcactgttagataaatcttgaggtatcgagccaaaatcctgtaaatattaacactgctattactgacttatacctgtgtaaacacagtatacaaaagcctacatcaaaataattcacttcaacaaaagtactttatatcaggtgacattagagaaaaagaagtaaagcctttgctgtttaccgtcctcctgcaagcatctgattttacacataaaacaggcttcaatttgaagcctaagtacaggtaacatacaaaaagtaaaacttagaagtgccaacatgagataattcaagtacaatatatgttaaaaatatatatttatttcaatttttagatgcttcaactgttacaggccatcatgatttaaataaaagaaaaaacatttgagaaagaacaagaaccttttgtttagagaatgaaatataaattgttaataaacaaagtccacaacaatctcttaaaaaaaaagttactacagttatttctcttgtgaatatggcctggaagaatcacttttcccccaacttaagggaggtggagatttatctctatccaagctttcagtataagcagataagaagtaattctcattttcttgagactgacttgatgaaagggcatatggtgtccccaaaaatgtctgatgagtgagaacattaaaatgactaaactgatgggacatatttaattgactatgataaacctgaaagttactatatgaatcttgttctgttgaattgctgttctctccttcagagcatactatatcaatagaagttctctcttcagaatcaaggtaagtcttatcttctaataaactgttttgcacatcaggagacgattgcaactcaatttgagtattctttttttgatctgttccacgtgatcctttggtctctttctcccatatttctgaatgaaaattgctgcatacttctatatgtgagatttcatcccctgaatccagagacatatcctcttcatccttttcatcgttttctaaaagagctacatttaaaaaacaaaaagtcctcctctattgaaatacacagtttgtttaagttttaaaattatacactactcacacaatataacgcgtcagggtctgcaagtccacaatcccttaaagcttggtcttctgccacaagttcacttagtcacaacactcacactagatgtgaatgtccagataatccgatgctaaaagcttctgcgaaatgtgttcacgtttaatgttgggaaatcccaactcccagctccaaaggggttaatgtcaaaacagcatctaaagttatacggtaattcagtatttgacaagacaaatataaaataaaattttttgacatctagcttcactggattactaaactagttggttagcactaaatgaatgatcatttctgctttttttcatcaaaaacaaaagtacatctttcattttacacagaacctggaaccaaagcagaggccatctcacaaaagattaaagctatgacagctctactatcttgcaattaaattgctttatgcatgtggggaaatctagtagctcaatgctaaatcgccatatctggtttcctacctttttattaatataacccctttgctgacaatagtaaccaataatgcttacaaaaacctcaaagacaaaatgcatactccatagtatgcactgtctacaatataggtagaaatgcataatctataataacttacaacttacactggctacagtataataaatgagcagatcttgtgcatgctaagtattagaatgataaatgtcttgaaacactttccctatggctgtttatactgaggtacgtggtttcaaaatggtcatttcattatttggtaacagcaaaaccattcctctttttctgtctgcgttaaagaaaatgaaaaccactgaaaagttacctgactgcgactcaagattctcattagcaccaagctgtggaaggttttcttctgtgattgaattgtgatagcccacaagatttttaaagttttgcatgaagtcttcagcagttgcaaccactattccattatctgtataactggaaagcatcttgatgttcttctctaaattaagaaaaaaagtttcatgtatgaaacacttcaaaatatagacagcccctagccctcacaaaatcttttccttcacattttcagaatcaaagcttagcaatacccaccacagccccataaaatcctttcattcacattcctatattcatagtagaaagcttaggagtgctctctttacctgttaaaaagactatgtgtcgttgctgtatgttctgagcctgaagtctgataaggcaatccaattctggagcatttcgagtttgtgaatcacaattgtggtatgacaaaatttcaaccagatgtttcttctgatagacattcagaagcgtcaacagacttagagctttagcattcaatctgtgaaattaagcagttcagtttctggatctgtacttctaaaatttagtatggaaatttctgctttagattaaaattcaatttctccactgaggcaactaatgacaactgcactgctttagctctctgcctgatgtagggggtgtgcttctttggaaagaaagaaagaagggataagtccaggggtttcttggtcgcgaggcctcagggccagctatacagcttaggctaaaatctcagctgattattctacttactaaataataaattatgattacctttattaattttgaactttaatgaaggacttaaagggacaaaaacagtataaatccttccttcaaaaaacacaatatatggaccaggcctggtggctcacacctgtaatcccaaaactttgggaggccaaagcagttggatcacctgagatcaggagttcgagaccagcctggccaacatggtgaaaccccatctctactcaaaattcacaattagccggatgaggtggctcatgcctgtaatccgaactacttgggaggctgaggcagaagaatcacttgaacccaggaggcagaggttgcagtgagctgagactgctctattacactccagtctgggcaacaagaacgaaactctgtcttaaaaaataaaattaaatacactattatggctctaagctatttcttttttttttttgagacagagtctcactctgtcgccgattctcctgcctcagcttcccgagtagctgggactacaggtgtatgccaccacacccagctaatttttgtatttttagtacagatggggtttcaccatgttggacaggatactctcaatctcctgaccttgtgatccacccgcctcagcctcccaatgtgctgggattacaggcgtaagccaccgtgcccggccagctctaagctgtttctatattgcaagggacaaggcaacaagtggagataagcttttaaaagtgaattgctacaatgaattaaatactcaaaaattatttaagccttaatttcctgaacagtgtaccatggaatgtcgtattttaagaaatttttgtggtataaagtttaaggaaataatgattgacacaatgtaaattcttttaactagagttcttcatatcctttaatgtgtaaatacattttatagactttactagtagaatatagtgtcccaaacatgcctgattaccataatcatttatggaatctctcaattgactagtgttccaaagatcacacttggagaagtgacttccatgcattttagaaattatctatgtatacatgaattgatgtcctactcacaaatcacttcaccaggtcaagattaatccttgtccaaatatatgtaattttattagctacctataaagtagtcagttgggagagggcctgatgtagttggcacatacagttcagttaaaaaaggaaaatgctggccaggcacagtggctcacacctgtaatcccagcactttgggaggccgaggcaggtggatcacctgaagacaggagttcgagaccagccgggccaacacggtgaaaccccatctctactaaaaatacaaaaattagctgggcatggtggcgggcgcctgtaatctcagctacttgagaggctgaggtaggagaattgcttgaacccaggaggtggaggttgcagtgaggcgagatcgtcccattgcactccagcctgggctacaaaagcaaaactctatctcaaaaaaaaaaagaaaaaaatgctgatcattccatttggatgattactctaaatccacaaatggcaaagattaaaccaattttacctatgcacataacaacttcagcaaacttctactgaaaaatactgcttcttataaaggctagaataattcagtatctatactcaattatggctggctatggacatctgtgaaaaatgaacatccataatctacaaacatgggaagagagaaatattatgagtacaatgttaaaatcaacaaccattatatagttatgtttcaaagcttacctgcctagttcctttagtttcttctgaaatttacagtggactttccattgccattttccttctggagtactaagttcctcaaggaatgtcaaaaaatttttaaggttctctgttagagataatgaagtttgtttttaattcaataaataatcattccataagtgaattatgaaagaagtgttttttcatattatgtagaaacacctactttcctatgtactattttcatttctctttgtctaagggagacagatctatacatgcctaaagctctaataatataacatctacacataaaaaagaacatgttgatgacagtaatacaagaagtgattcaactgcagcaggggcagacagccttgctttacaccacatttagaggatattattggtctaagagaaggagaaagaaatttgaggtaataaaagctcaagaaaagactgaaatgtactagttatctgtgaatggcagaataaatggacagtacattaaaaagtatgagagtcagaagaggagttacgtgctcaaaagaacatcatcttaccaactgtgacaacctctgggtttagaattgattcatcagatacgataaaacctccagatacaaataattcattgtatgtatgatttttaacatcatccaggctatcaacaccagcaaaactaacacaggggagcttctttaaagtcaccaagccaggtatctgtttaaatcccaaaacaaaaagagaaacagatggagggaatgaattgacagactcaagtgtgaaggaacctacaagaagtctaacagaatgcattatggctcatctatattagtggattacctctggaaagccacacaaataatattcccaacattatttcccaatatataaaccaacatttatgtactgggacctaccacagacgactaaggaaaaggagcttacaatagacctgaaaacacaaaatggacaaaagctgacctctctataacctgtgagtacagtcagaattcagacgaaggcaaaagcctatgtgctcgaacagtcaatcaggaaagacgtccaagatgtaggatggagatagggctcctaagactagatgggatacctcaaaatttaagggaaaaggggactggtctggcaaagatggagcacaaataggtttttcctaggacatacaaatgaagatgaaaacattatgtagtcagtcagcagacccaatggcattcaaggattcagtactcttattagtcttgactacctgagtgacagggaagatctgtgatgtgcagcaatttaaaattttgcataggtacaaacttgaatctcacaagctgattcacagatgggtccttaagtttaatctcctttaaagcttattttaaaaacactagtctggcagacagtaagattttaaaataagggagtttttaaaaccaaagtagtgaatttgacttaatagtctaccttgtgaatgaaacctgcaatgtcttcattttgaataataatcaatagtttatctaattttgatcttctttccaaaaactgttcaggatgacattctgtattgcctaatttgataagatattcctgttaaagaaaaacaactaaatcaatattaaaatacttctttgtaaacatcaatttaacaccagaaatgcaagataaactgataagcttaactactaccatgacattattaacaatgaatgaacttacactctaagagaccatcaaatcctttttttttttctttgagacagggtctcaccattgcccaggctggagtatagcagcatgatcacagctcactgcagccttgacctcccaggctcaagccaccctcccacctcagcctcctgaatacatggatggcactaggctcgcaccaccataccaggctaatttttttttttttttttttttttgtaagagacagagtcttgctgtgttgcccaagctggtcttaaattcctgggctcgagtgatcctcctgccttggccgcccaaagtgctgggattacaggcgtgagccactgcacatggcccaaatccacttttcttttctagaagaggaatctaaaggtcagagcttcaccaatcacatagtcacaatgttacagagcttcaccaatcacacagtcacaatgttacagcactatgcaaagccagccaagtaacagtgtgagttaacagaaagaactgttaattaggccaggttcttaacccagctcctttagttattatagaggttaatgattagactctaggttgactataatatcctatgagaaacactttaaggcaacctagagtctaatcattaaccactccctagctcaccttttcctttccattctaagtaggcccttggttatttgcagcagtattaactgggataaacgccttcagagttaagaactttcacaaccatagctctaattcacaacagctaaaaaagcatttatatagagcttcattatgtacaatggtattcacatacaaattagccatttctgtcaagtttctgtcttcaaagtagactttcccaactagtaactcttcctccatgctggtgaacatggtactgcctttcacaggacacaggcagactttcatgcagagttccctttgctctctgcttgctggtggaatcctgaacactgaagcaaactgcaggatcctggaggtcatattcctcatttcagagattacttttaatgtcagcacagctggtcagacagctataataaaaacccagcttacctgacaaccagtctgctgctctttcaacctgaagtgttaccccaaagaggatgctgttgtgctaaagcagcaccttctacactgattttgatccaatctctggaacttttgggcagatctcagaccagcttagtcagttaatgaaaaggtaaattaccatctgacatgcctgctggtaattttttttttttttgagatggagtctcgctctgtcacccaggctgcagtgcagtggcgctatctcggctcactgcaagctctgcctcctgggttcacaccattctcctgcctcagcctcccaagtagctgggactacaggcacccaccaccatgcctggctaattttttgtatttttagtagagacggggtttcaccatgtcaatcaggatggtcccaatctcctgacctcgtgatctgcccgcctcagcctccctgctggtaatctttgatgtcttcttacattaagaagctttaagctcattttaaataagacagtttaattcacataataaatcagtttgactccagaaatatataaagtttacatttttattcataaagtcttttactgtagtatttttgctggaatatttccaatggatactgattaaaagaattaaagtttcaatctggttttctatcagattcgtaaaacaaagaatgctcttttattctatataaatgacagaaatgacttattctatgccagataaattaaaagcacaattaattaggaaatgcatctcctatccccttaatctaaatgtaacggctgggtgcgatggctcacgcctgtaatcccagtactttgggaggccaaggcgggcacatcacctaaggtcaggagttcgagaccagcctggccaacatggtgaaaccctgtctctactaaaaatacaaaaaattagctgggagtggtggcgggtgcctgcaatcccagctatttgggaggatgaggcaggagaattgcttgaccccagaaggcggaggttgcagtgagccaagatagtgccattacactccaccctgggcaacaagagcaaaactccgtctcaataaataaataaattttttaaaatgtcaaataggtatgtgttacaaatccttttaaaaaaaggagcgggggggtggggggtggggggtgcggggatggaggaagttggagttatgctaagcacaccgggaactgtgcccaacctattctctcatctaaccccaaaccaatatgcagctagctatgcccccaaagagtactgtgctagggaacttgttgctggctggtggggaaaagttgagaaactctacattcagtcatgtagggcaaaaatgcaaccaaggaattcctagaagtcttatttcattttcccaagaaaccattagcaatcagtaaggaaagcccaacacagtactctgactcatgtaatttctatgttcttcaggtcttgaccaggtaacatcacacaaaacatgctgacctcagagatccccaaacttacagaaggcttaggacatgttagtagctataaagcccatggtccctctgcttcctctaatgaaattccagtcatggtaagtaaactccataaatgagagcaggcatttatttcaaaatcctaggcattcccttgaggaattaaaatcccataatttatgattaattttactattataccactaatgtaattgctccaatgtgttaccatttacctacctactggtaacaaacttacgtatctatgtctaaacatacagacacacagaaaggcgtgtgtgtgtgtgtctgtgtttttttgtttttttttttttttttgagatggagtcttgctctgtcgcccaggctggagtgcactggcgtgatctcggctcactgcaagctccgcctcccggattcaccccattctcctgcctcagcctcctgagtagctgggactacaggcgcctgcccccatgcccggctaattttttgtactttagtacagacggggttttcaccatgttagccaggatggtctcaatctcctgaactcgtgatccacccgtcttggcctcccaaagtgctgggattacaggcgtgagccaccacgcccagccatctgtgtgtgtgtttaaaccaactatctaaaatattagtctgcagcttcggtagaaaaaatacacctcacaatgagaaatctttcatgactgaggagtctttcaagattatcaagtttcttgatcaataaaggctaaagggaatgttacatggctagggtatcaagaaacaccaaaagtttatcattaggccaaccctgggcagtttgtttttctatatgattgatcaaatcccatgagataaaccctggcaacttaacttttcctctctgtttttttccctcctcttcattaaaaatgcaagaaacggccaggcgcagtggcccacgcctgtaatctcagcactttgggaggctgaggtggacggatcacgaggccaggagttccagaccagcctgatcaacatggtgaaaccccacctctactaaaaatacaaaaaaaaattagccaggcatggtgtggcacgcctgtaatcccagctacctcggaggctgaggcaggagaatcgcttgaacttgggaggcagaggttgcagtgagccgagatcacgccactgcactccagcctgggcgacagaaggagactctgtctcaaaaaaaaaaacaaaaatccaagaaatacttaaaaccttcaaatcaagtttaaaaggtatgtgcataaatgacactataaaacaagattctaaattctaacatagatcagaagttctgaatttacttggacttaccactcttttattccaccctgagttaaattatgaaaatacacaattaacatttatttttagagacagggtctgactctattacctaggctggcacaatcatagctaactgtaatcttgaatgcctgggctcaagtgatcctcccacttgagcttcccaagcagctgggactacagtagagtgccaccacacctaatttttgttattaatttaagagacaatgtcttgttatgttgcccaggcttgtcatgaactcctggcctcaagcaatcctcctgcctcagcctcccaagttttgggattacaggtattagccaccattcctggcctaacatttaaacacaaaacatttaaatacaaaaaacttccattttatagaggtcacaccaacaagagaagtttgtacagcattactattaccttctggtttagttacctttatttctttacagagcacactctcttcttcttcatgaatataaaatttcacagtatttttctggacgtctttcatgattttaaccaaactattaaatacttcaggttctaactggcttataaaatttgaaagagctggttgagcagaaatgtttacatcactgggggattttgttgtttcttctactggttcccgggccatatcaccaggtacaatatgatcagaagtcaccattaactctgtggcatgttgaggctggttcatttctacttcagttaaagccgaagtggaatgctgctcatcagagttggtatctttcaaaggatcactacacagtggctcaaggagatgtttattgttgaagtcacttgaggaaactggtatgacatgcctttccagaggattcgatgctatcttagcaccagaatcgttaggactgactggtggcaaattcccacccttggctgatgctttaataataatagtatttagcttctcatgcaaaccatctacaaactcctgcacaccagctttggaagtcttagaatatatgaactcggaaagccgtttcatcttctcttgtgttgaaaagataggtgtggaaactgtactgacatatgaaacattcttttgcttcaaaatctcttctatcttcctagaaaagagattgtactctcctaacactgtcctctctgtggtttcgctcactgcaggcggctctgcctctgctgctggcacacactgctcctccacctgacctgtcaacacgtcatcctcagtggtgccctttagtgtgtctgtaaatggagaggatggaaactggtaatcagaacttctctgtctatttattacccgggggtcgttaggaaaggcctcctgtggtggcacacacaccagttgttcttctggtgatttcatacctatacaggaagagttcattattataagagcaatccaaaaagataagatatgaaaacacaaacccttaaattgggggaaaaaagggttaacacacatttagaactaattatatattagaaggtaaaataaaatcctaaaattctggtatgaattctattccctatgtgccctacttatgggatggtccttagagttgtagctagtgttaacaactctgctattttgaagcgctcaagcaagcaccaatttggcatcaatacaaattaagtcatttgcttgtttctgcctccctaccattctgtagatctaagtttaatacacattttaaatcaagacagtcaattacatcagcttgctcaatccctgtatttattatttgccaagtaatatctactatggtaatggccccttagtaagaattctgagtgtaaggcaattgtaagaataccaaacagaaatgctgtgggaataactgccaagttaaaagttgcatctaggatctaggataattaattttatctgctttcagacttgttctcacttacgaggttgctaagtagatttcctgtaatgtcagggacttcattttatcaggaaataaaaggaacaataataagacaagagaagaacatatttcacagctgcacatttttgacagtcctttcataaatattttccttttgtttggaaataattctaaaagaaaagatagctatacctcatttgagatacagatgttagctgatactaaggttagctgatactaatgagattaaaacctttcactcttgacaaacagctcaatccaaaagatcatactttccccaaaaaaatcctaaattcaaacacagtatgtttttgaaactacatttgaaaaagggaactctaattccatttttaagcaacaaggggaaaaatatatttaacttcaattttagtgttatattttaggaaaggacaaaaactcatgatctttgcttagaagacgtatacacaattttacccgctaaaaaattactgtttttctttaagccttggccaacattccctaacaaattgctgctgtagtataggaaatggtgcctctaaatcagaaagtccaggtacaggtagttttcaaacttacagtgaagattttgctcacactcatcacacttttctaaaggtttaaatagcctcactaggagtcgagcttatgacattctctaccaatcctggtggttatcatgaaccagtacactcattaactattgcaaaggcaatttgtcagcacagtgaaaagacccaaggcgggtctgtaggcggaggtgagaggggaacaaaatatccaacgtgccaggataagaattagaactgtatgaaattgataaaccagaaaatccaagtttcataagataattaggagtactaaatatcctgagtatcttaaatctccaacattaaaatgtgctttagtacacataaagtgtctggaaggatacacgagaaattggtaaccatggctaatatatggggaagaatctaagtgttccgggctggggcagtattactttcttaagtatttttggacttcttgaattacgtatcatgtcaaatatctgatatattcaaagaaaaaaaattgaattgcatctcataaaacatatgggttgcgaagaactaccttaatttaaaaaattctgaattatttattagacatggggcctcactatgtttcccagactggccctgaatttctggcctcaattcctcctgcctcagtcttccaagtagatgggattacaggtacataccaccacacccagctatttattactttaaatgcaacagtggctcccaaaatgtatagctaaacaacaaccagtaagtttactcctcaagggttataaataaagggaatatttttaacctgaaatataaattaaatccacatggagaattttccataattaaaaacctctaaaccaaatagatccctttataaaatataaataatcacaacctaattttattttgcacaaatttccctgtatgattttattaagaacttaactgctcaggcacagtggctcatgcctgtaatcccagcactttgggaggccaaggcaggcagatcacctgaggtcaggagttcgagaccagcctggccaacatggtgaaacctcgtctctactaaaaaaaaaaatacaaaaattagccaggcgtggtggcgagcacctgtaatctcagctactcaggaagcagaggctgcagtgagccaagattgcaccactgcactccagcctgcctgggcaacagagcaagattctgttgcaaaaaaaaatagaaaaaaaaaacaaaacttaattattttgaaaatatcttcatctataagtgattgaaaacacacatacatgtcaatccataataaagcttttgttgttggtggtggtggtggtgttgttgttgttgttgttgagacagagactcgctctgccaccaggctggagtgcagtggtgagatctcggctcactgcaacctccacctcccaggttcaaacaattctcctgcctcagcctcccgagtagctgcgactacaggctcaagccaccatgctcagctaatttttttatttttagtagacagggttttaccatgttggccaggatggtctcgatgtcttgacctcctgatccgcacaccttggcctcccaaagtgctgggattacaaacatgagacaccgtgcttttttaaaaaaaaacttattgccattaaataattgcagtattttaacttttaagtgaaaggggagtagtcagttctctaaaggcaccatcattcagatgtctacactttagcttacaaaatataaagatggtatttccaaataagaggaatgcaggtgctgatggaacattctgaagcataagaaagataactactagccgggcacagtggctcacacctgtaatcccaacactttgggaggccaaggtgggcagatcacgaggtcaagagattgagaccatcctggccaacatggtaaaaccccgaaatcagaaaagaattactgatagatgcaaaacatggactccctgacacgatattgcatgaaagtaccaaacacgagagacgacatgagtaggctctatttatcctaagttcaacaacaggcaaaactaatcagattagcacttacttgggaacaaggagagtactaactaggagaatgtggaagaaaatcttctgggatgctagaaacgttctacatcttgatttgggtgatggtcatgtacatatgtaaaatttcaaaaagctgtacaataaagatctgtggccaggttcagtggctcacttgaggtcaggagttcgagactagcctggccgacaaggtgaaaccctgtctctactaaaactacaaaaatcagccgggtgcggtggcacatgcctgtaatcccagctacttgggaggctgaggcaggagaatcgcttaacccaggaggcagaggttgcagtgaaccaagatcatgccattgcactccagcctgggtgacagagagagattctgtatcagaggggaaaaaaaaaaagatttgtgaactttcctctatgttatatatctgttgttcatggtttctttttttttttaaccacattttcctagaaggagatggtgaagattttcttcaaggaaactagtaactttaattagcgggggaggggaactcccaaaggaaataaataactacaaagatgtagtcatttcacatttcttacaaataaaaaaacaacactttaatttctgaaaagagtcagatacaacaaaactgaaggaaaatataaaaaagatcaccaccaaactgtaaacaagaaaacaatgcctatgaccatctgcagagaagttgaatccaccaagatcagacaaagattatctcctaggtacccactgccaactagctaatcaataatatctgcaactgtttctgaaatccaagtttcttaatcttatttaatctacctgcagaaattagttttacaatcagaagaactaggttaaaagactatgaatagtatacctaaaatataaatggcttacccttcttggctattttttaaaaatttaaaaaagaagaaacccaggtttgggggctcaagcctgtaatcccagcactttgggaggctgaagcaggtggatcacctgaggtcaggagtttgagaccagcctggcaaacatggtgaaatcccgtctctactaaaaataaaaaaataagctgggcatggtggcatgcgcctgtaatcccagctacttgggaggctgaggaaggtgaattgcttgaacctcgggaggcagaggttgcagtgagccaaggtcacgccactgcactccagcctgggtgacagagcaagcttccatctcaaaaaaaccaaaaacaaaaaaagaagagtttatcataaaatatactgcacaaatggcttaggaatatattctggtcttcccaaatcatattgtaagatagactctactatgggtgaagaaaatttatataaatattcggtgacttatctgaacactctttatagtaagaatagtggatacaactcaagtaatgatttacatataaataaatatggtactgtccaaattttctgtaattaaaaaaatttaagtcaatgccctattgatggagtatcagaaatgcaagtagcaactctgaagaagggcacactgggaagaaaagcaaagcaagccttctcacctggtgtttgtttctcaccatgtttccccagctggtcttctgggcttcttgcattccctcctgagggaaagcatccattagactctcttcagacattagtgatacctacactaagcacctttcagacaaccccaagtgataacaatgcaagcattccttcttctgcctaaaataatctgaagggtcatactggtgatgatggaatatcaacacttaagacattgtaccttcaaatgacccaacaccaagtatgaaggtgtctaaatgagaaacggttaggataaccttcttatatcaactacttcttttgtttctcctactcaagctgatgtttccacctcataaaacaatactaggttccctctatcatcacctacaggcctcctaccctccagaaagatgttaagtagaagatggtgctaaagcccatgggaactcatcaagttttataaattcttctcagagtcctcggaagtctcagcaggttctagtttagttcacaggccagtctactttgtaacaaaaagttgtttgctgttgctattgtttttaaaaggttagaggtgtaggactggaaaagacgtataccctgaaaatatttccaaaaatgtttagctagaaaagtgagtaacaacttggaatattaagagtatgtatttatgtgtgtgtatgtatgtgtttgcacagagaaattagaatgctaccaaaaaaaaaaaaagataatatttcaacatctgctaaactttttgcctcacagttcaataacatttacatttgatcattcaggccattctctaagataatccaatttatttaagataatccagtattaagaaatcaaatttctaatagatgaacctcaacattatcacttattagatgacagcttgttacggtgaagtttaaagtttgagaagacagcatttaattggttgtccaaagagcaccattttatctctgcagctacctcaccttatcaaaaactcagtttctgccaacagtcttcattcagcagtctgcatgctaaactccatagagacagtgtgtcttaaatccctgtttttaaggtgattttgcaggtgcttgctgatgctgaccaagaacagcaacactcagtgatgaacactgtattactcaaaataagacactgaagatgtcagcaccaattaagatgaagcacctagtgacccaagagtgaaatccacagaagatggaaacattcaggaaactggtctctaagtaaaatgaagcaaacacaagtccaagtatacttttcttacctgtaattggaatcagtttccaatgtatttcagtctcttcaacattatttgacttagactgttgtctacgaaatccatgttcaatgggaacactgggacacaaactgcaatcttcaaaattattcacgctaattaaatttggatcctaaaaatcaaagtacacactgaatagctttatttccaattcattttaatgtcaagaataaactgttttttcactgaaaattcacgtgcttcaatctaaacattacaaatgcgtaaaatcaacatggtaaagttatactctagtttcaaaattaaaacatcttttccctcgaaacataattttatgttaatttagaacagggattggtaaacgtttgtgctgaagtgccaaacattaaatattttaggctctgcaggccagactctctagtctatcacaggcaatacctaaacaaatggacacagctgtactccaataaaactttagttataaaaatgggtagtgtgctaggttcaacccatgcccccgccccccatcaacttgatttaaaatacaaaagatatcagaaaatattaatacaggttagttcctcagtgcctaccttacataccccaataaccctcctgccatcatcttccccttgaaataaatatcccaaaacgacatcgagaaagaatggggacatgcatacaacttttaaacaaaggcagggaagagaaaatggagacagtaaatgaagaaataagcccataggaatacggtgcaatcctagaactattccccagtgatgcagtgactgcttaaggcagataaggctacttctcagctacaaaccagcactctgaacatatatcataaatatactggacactctaataagcaaggctgagagtcacttcaggggtaatcctaaaggctgcttatgttccattcctatttgcgtaagaaataccaagtacctaactgtcacactgctgtactgagactggcatcctcatctgcctcacctttgggttctctgttactgccgacagaaagccaatgctttaataattcaacttcattatgaaacaataaggaattaactcccaataagccatttctgacaaatattaatagattgttccgcctaagctttatcacaagtaaactgtagacaatatattaagcttctaagaaggaaggaaaactacttcagcatttatctctttgtaacaaggaataacttaggaagtaccatcctagacaggcacctttactcaaaagtgcattttatttctttttcaaagaaaaaaatcattccctgaagcatactcacagcacctctttcacacacacactcacaaacacaaaggtaaccaacagctatatgcttacttctttcaaatgtagcttatggtcagtgcccacttcgctggtagaaatagcaacagaatacttagatgttgcatcaacttctagtaataagctctgagtacccttaaactgtgcattttcaacttttgcacaagtaggctgctcatagtctttcttatctggggtagagttcaactcatactcatgtttttgcctcagctcttcataggcatcatcagtgctcaatcctaaggctttgttgactgtgtctgtcagagatgcatcagaatggcgcgcatttgctagtgtttctgataaccaattaaacagcctatggatgtcagcaatgccggagttacaggtatcctgctgctgccgcctcaagtcagcatcatgtccaagtgagccaataggctgtggagactctgagaaaaaggaagtcattggttgaagttaagtttaaaagcaagcataaaacttttaaaatcaaatatacctaaaaaattatcataaagcatttatggtcaggaactcaaccaatttgcttagactttacaaatattcgcatcactttacaaaaagaattgtaaaattttgcacatagttcaaaattgctattaaagtttaatttccattgtaatttaagcattctatcaataggaaaataagctcatgcattaggttttaaatatgtgtattaataactaccatcaaaatctcaaagtcaaccaggtgcttgacaagagatgaaacatttgtaattactattttgccaattgttaggattatatgtgtattacactaggctactaaaaaaatgacaatttgatttctatcttttccatacctattatattttgtccttaaggcattggctgacacacttaaaatctacaccttatcttgaatgactagattacttaaattcataatgaagctagggtattatagagataaaatcaccctgaagaaatctccacgaaatttgcatcaagaacaaaaagtattataagaggaaacacgttaagacatggtttcatgcatgcactataaatctgtataatctgtaacaatcaatatattttaaaacttgtaaagggcgcaaacattcagaaagtcatgtgctttaatattggggtggggtagggattgggtgaagcctgagttaggatttcaaatttaagagtataatgtaccacaacaaaaataaatgtcagaaacaaaggagtgcatactgtatgactctaattatgtaaactttttatagagcaggcaaaactaatctataaagacaaaaagcagatcagtagtggagtggggtgagctacctaacaaagaacacaaagcaacatataaaaatgttctggccaggcacggtggctcatgcctataatcccagcactttggcaggctgaggtgggcagatcacaaggtcaggagatcgagaccatcctggctaacaaggtgaaaccccgtctctactaaaaaaatacaaaaaattcgctgggcgtagtggcatgaacctgtagtcccagctacttgggaggctgaggcaggagaatcacttgaacccaggaggcggaggttgcggtgagccgagatcatgccactgcactccagcctgggcaacagagcgagactccatcaccaaaaaaaaaaattctataggctcacgcctgtaatctcagcactttggaaggctgaggagggtggatcacctgaagtcaggagttcgaaactagctcagccaacatggtgaaaccctgtctctactaaaaatacaaaaattagctgggtatggtggcacacgcctgtaatcccagctactcggaaggctgagataggagaatcgcttaacccaggaggcagaggttgcaatgagccgagatcgggtcactgcactccagcctggaagacagagtaagactccatcttaaaaaaaaaaaaaagttctatatattggagcggtgattacacagctgtcaaaactaatcatactgtgtgcttaaataggtacactgatataaactgtacctcaaaacagtttatgttaaaagttacaaggggtggtgggaatgggttaggaggttacctcataaaatgactgggctcaccaccaaatcaagatcagggtgttttaaaagttagaatatggctgggcatggtggctcacgcctgtaatcccagcactttgggaggccgaggcgggcggatcacaaggtcaggagatcgagaccatcctggctaacacggtgaaaccccgtctctgctaaaaacacaaacaagtaaccaggcatggtggcgggcgccccagctactcgggaggctgaggcaagagaatggcgagaaccagggaggcggagcttgcagtgagccgagattgtgccactgcactccagcctgggcgacagagcgagactccgtctcaaaaaaaaaaaaaacaaaaaaaaaagttagaatacaaccttgaaatctctaccttcagaaacaaagtatgcaaaattacttaaaaagaaataagtaagaaacacctaaaaatgcaagtctgatagtcactagttttagttaagcattctacccttcttcctctgctccatttctcatttggtttattataattagtatggctttctcatcattttaattattgatgaagcctgatttttacccacaactattttttcacatacacagaattagttaccaacaaaaacagtaccaaaaaataagtatcttatttattgagtgcatataatgtgctcagtgacaggaaatgcagcagtttgttgtcaacaatgctttggagtcagtcagaactgacttcggattgtgccactaacttcataacttttggtaaagttatttaacttatctgagatgattttctcatctgcaaaattaggataataatgcctatcactcaagaactattaataaatgagttcatatacataaagtacctagcacatagtaaacagagctctcaagacatgtcacaagataagacagtatgtgtcagtaagtgctaacaggttcagcacagattgcaaatccagcataaactagaggagaccattaaggagaatagacagaaagctgaggagaatatgaactgcaaagatataaggcttgaaagaaatggaagctacttcaggaaaaaaaagagggaaataaaagactgaccatgacatactctaggcagagagagatgacccttaaccaagacatgtgagagaacagtgggaaacatggctggacatggctagtctataacaaagccttaaaaagcaagtatataagatgagattggtagcaaattagcaaagcaatactgagaagaacatgatactgaaacgggtgcaagaaggtagtaagtcaggaaggccaccaaagagataaagaacacagacaaagagtaacaacattgcaaagagaaagagacacacaggttaactaaagaaaaaatcattatagttactgcaaagaaaagtaatgtcaaatagaactttctgcaataatggaaatgttctctctctgtactaatacaatggtgtggttgttgaaatgtattttaatttcattttaattcaaacttaaataaaaacatatggctagtggctaccacattgaataccataacaataaaagaagtaaaaggagagcaggctgagcatggtggctgacgactgtaatcccagcactttgggaggccgaggcagacagatcacttgaggtcaggagttcaagaccagcctggccaacatggcaaaaccccgtctccactaaagatacaaaaattagccaggcacagtagtacgtgcctgtaattccagctactggggagactcaggcacgagaatcttttgaaccaggtaggcagaggttgcagtgagccaagactgagccactgcactacagcctgggtgacggagtgagattttgtctcaaaaataaataaataaataaaaagagcaggaaagtgaaaagtgaggatacaaatacagattgctaagagcaaaagtgtaaaaagacactgatctgactaacctagactaagacactgatctgactaacctagactaagacacactgaatctgaagagacaagttgcttaataaaaagcataagaatattcagttctgccataatcagaggagcaacagtaacacaaaacgtggattgttatgtcaactttctatgaatgcaaaagaactcattctgtgcttatcaactagtagtgtgaagatcttaaaaatctagataaaagtgttttagctgacttgcaatattgaaacaaacacacttaaaacaagcgccttacatgtctatctttttctgtcaactaaaacaaaacaaaggaaaaaagaacaacaaaaaaagaaaaacccaaagatattcctggattcttggggtagaaaagagtatgtgtatgcatattttattttcaaattcagaaggttccttttcattatgcaacagcctaaaagatactactattctgatattatacttcttcaactataaaaataaaggaatatggccaggcgtggtggctcacgcctgtaatcccagcactttgggaggccgaggcaggcggatcacgaggtcaggagatcgagaccatcctggctcacatggtgaaaccccgtctctactaaaaatacaaaaaattagccgggcatggtggcaggcgcctgcagtcccagctactcgggaggctgaggcaggagaatggcatgaacccaggaggtggagcttgcagtgagccgagatcatgccactacactccagccttggggagacatcaagactccgtctcaaaaaaaataaaggaatataaaaggacaagagttctgattagtattattatgtcatgttaacctaaaccaaacaatttagaaatctgatgtaccagggcaggaattgtaaagtgtttcctgtactgggccaggtagcaaatattttaggctttgtgggccatacagtctcagtgccaactctgccatgacagcatgagagcagctacatacacataaataaatgggcatggctgtattcaaatacaactttctttacaaaaatagtggacaggctgaatttgaccctcaggctttaatttatacgcccctctgctacaagaaagaacagaactactttatttttggctgttataagagcaatctgatattttaccttcatacagatggcaattttcagataaattactggttttggcgagctttctcatattttcaggtagatcctcaagcttcctcttcaagacagttttgcttctcatatcttctgtgtctgagtccccacccacactctttttcctacactgaattaaattaatcaattctttgactctatccttatcataatccaaagaatgagatgatctttgctttccagatataatggcttcacctcttgagttatttcgttttccaaatttcatttttgtaccattcatttcttcttcttgaccttcataatctgaaagtggactaaactgctgaagttttctattttcttcaaatagttcttttaatttacaaataggtaactgatacacttcaggccgaaaaatataggcatgcaaacaagtatcaatatgggatttatttctgggagctgagtataagaattttttatcatctaatcgtgaatcatatggaaacataataaactctcgtttacctgaaccaaaacctcgcttaaaaaattcacttacatacttttcaacaacagaatgaaaatttatggcgcttatatttttgaattcctttcgacactgaatcaaagaaaattgtaaaaactgagctatttttaatacatctggcatgctctcatgcctctcctgtggtgctgcattggttgaacctttttgtgctgtaaataaaacaaacaaacaaaaaagcaaaccatgttagcaatcaagaaactaatcaaatacagatctaaatattgccaaagaagtataaaaacatttatacattaatgttgaaccagacgagtatgtaccctagtacatatatacaatatagcaaatatatgaatagcatgcttgtaaagtccaggatcctaaaacaggccaataagaaactaaaacaaatgaaaaagcagaacacatttttaaaggaaaaatcacccactcattgaagatctcacttcctactgcccccaggaaattcaaatagtggcaagcaatatgtaagaagaaacagagacagaacaagatctgaggctccaagcaaaacagtcctgcatgtcatctcttcctcttataaagtagtaactaacttcacatgaacagatatgtagatgctgagtagccacaactgagaaactcatccttaatccaacagtgaaataaagccattagtgggaactttagcttaatacacagtattaaagttcattcttagaaaaggtggttaacaaatcttgtcttatatcagtgccaaaaattctcattaattttgaattgcctaatatttatcctggcaaatgatgctttagagttactaaaatttgaatgcaaaattgaactaagctaaaaaataatcatacaaaaccctcacagaccgggaatagtggctcatgcctctaatcccagcagcttgggaggctgaggtagttggatcgcttcaggccaggagttcaagaacaacctagacaatatagtgagatcctgcttctaaagaaaaaaaaaaaatttaaacttagctagctgtgctggcgcacgcctgtaatcccaagctactcaagaggctgaggcaggaggatcacttgagcctaggagggagggcaaggctgtatgtagtgagccatgatcgcaccactgcctgggcaacagagtgagactctatctccaacagagtgagactctatctctaaaataaataaaaagtaaccatcataactaagctacagtactataacaattataatcaagctttatgagagcactgataaacacaaattaatttttcatagttaaaaaaaatcgtcagccaggcacagtggctcatgcctgtaatcccagcactttgggagaccgaggcaggaggatcacttgaggtcaggagttcgagaccagcctggccaacatggtgaaaccccgtctctactaaaaatacaaaaaaattagctgggagtggtggtagatgccttgtaatcccagctactcaggaggctgaggcaggagaatcacttgaacctgggaggtggaggtcgcagtgagctgagatcgcgcccctgcactccagcctgggcaagaagagcaaaactctgtatcaaaaaaaaaaaaaaaaaaaaaaaaaaaaaattcatataatttgtgtcttatattgctaatacctcttaacccccagtatttcctgaaacatgaggtaagaaagacaaaatgtttagtgagttatctggaaaatttcaatgaaatgttaagtatctataagtaaccagatttagatattcaaagaacttacaagtaactatgcttctaggttcttgaaatagaaacaaagcatgtaggactcgagacttggcagtctgatattctaaaaaacagaagccaaactcattagcaatgtgttttaactaaaaagttaagaaagaattgtaaaaatttattaaagagagaccacctaccatatggaggaaccatctgataaggggagagaagaaaaaggtatcctcggtctcccaaaggtttaacaagaacctgtattttgaggggaaggaagaagttgtatctgctttattattattcaccataaggcagacacacagcattttctactaattgtaaagaaaaaaagttcttaatcatcttttaagaaaaaatattgctaatgaattagttaattctttctaccaactctgctgattaacaggattccaatcaaataaaaattccttggttttcataacattaatgagaaaatgttactgaaagaactcccctaactgcaaaaccacgttaatttttccctgaagctaaaatacaaggaccaagctaaagacttcaattttcttcatcagttcaaaagacatgtttattaatggccaaggtaatgtgctagatgctagatacaaaacatgctttgaaacactgcgttgcaagagttcagactaatcacaaacccaatgtgttgccataatctaactgcacacatattacatgaacacttttcacatgtaagggaatttgcccagagatatccaaatacaagcaacacaagatccttgatcacgagaagtttataattaggtagaaagagtaccacaataaataccagtaattacataagacagaaaagttccctaagagatttacaaaataacagaaatggaaaaatacagtttgtttacggtagtaaaagatggtcaagaaaggtttactgaaagtgtatcaaaagtggattttgaagaatgggtacactgacaagagcctgagattgtaggaaggacatttcagtagaggcaacaccatgagcaaaggtgagttgtaatggacagtttacaaacatcacaatatttatcactggcaacagggtgaggacagactaggataaatgtataagacaagtcgggaatgaaagatcatgggttagctgtaaaaagaccagaagccaggctggccaggaatgtccttgagagcatatccctttgagctactgtttccttaaaacaacagtaagaaagaagacttgacagcacagtgcaggacgcagaaaaacaatctaatgcaaagaatttatttcaggggctactgcaatagttcacaatgttttgggtaaatgagaaactgagcatggcaactgaacacaaaaggatatctgagctctgaaagaaaactcgtactacctaaattcctactaaaacaattccagtaaacaacgcctgtataaaaactaataattcagaggacaaaaagtaactgtgctactaattcacatttaataaaaacattgtttgcacactcaaaagtaaagtggtattgtgtttgggggtttcaggtagcttagttgaccactttctccagggtcaacttctccttcagttcaatctgtgccaaaaatgagtcttagatacctggtactcaaggaggttattttagtggaagcaggctggtggtatgggacagataaagtcatggggtcagatgaccaaatgactaggtccatctgaagaccattctaaactttggggaatctttccccatttttactgcctggattccatgagggtcagttatcaggtctttcttttataaaggaagttcaaatattcttgtaagggtaaactttgttgtaaggtttctaatagttaatctgtgctgaggtggccttgtttcctaaaaatcccagggccaaggttaaaaatcctcaggccaagttacatcatactgctgacatatagtattggccctgcaagatatttaactgggtcttacggctaccatttatagccacgctaagtctcttagagtatactacaagcggacaatgtacctgaaaattttgtttcaaatacttttatccaaagtattttagataatatacttcttttaatattttgttcaaactcctagttgatgaaataaaaagttacgaagcacaagattttcatgttttgtgctcactgacgaaaaccaattagatgcctttaacctctcactcactccaaatactaggttttataaattccactaccagtaacctaaagattcctgtattttaagggggcccaatgtttccagaaatccatggagtacaagcaatctatgatcagaaacaacactaaggctgacagaggcttcagcagttatatctgtggcttcagcccaatgaaatccattcaactctgcagaaaagaaaaatcctgcaaattgtgctcctgttgtctctattttagctgtttggttattcttaaaaaaaaaaaaagatattaatccaatctctggggtttttaaattagtttattctactattttaaatttccagataacattaaaggtattatagcactcccccacccccacaaaaaaagagttagtataaatacatgtacaatgggccaggcgcagtggctcatgcctgtaatctcagcactttgggaagtcgaagtgggaggaggattgcttgaagccaggagttgaagaccaaccttggcaacacagcaagaccccaactctacaaaaaaaattttaaaagttgtcatgtgtggcgtcatatgcctatagtcctggctacttggaaagctaaggtgggagaattgcctgatcctgagagttcaagctgtgaagctgtgattgtgccacgcactatagcacctcagcctaggcaacagagagtcctgtctcaaaaaaaaaaagcttagaaggaaataagctacactaaagtgagattcagcagaaaaaaaaagattcaaacactcaaaggcatcaaaaattggaattatcagatgcaaaaaggaaaataatccactatgaaatctttaaagacataaaataattggaagaattaaaaacattttcaagcaaaaatgtttacgctaatgttcatagcaccattattcatagtagccaagaaatagaaataactgataaaagaacaaacaaaatgtggtattatctacacaatgaaagcatactgggccataaaacagaatgaagttctgatatatgctacaacatcaatgagccttgaaaattatgcttagtgaaagaagccaggcaccgaacgccacatattcttgactctatttatataaaatgttcagagcagataaatccatagagacagaagtagattaatggctgttagggattaggaagggggaatgtacagtgaattctgagatgaaaatgttcgggaattagatagtgttgatgttgcacaacagtgtgaatctacttttaaaaaaaacatagaattatatactttaaaatggctaaaatggctgggcacggtggtgcacacctgtaatcccagcactctgggaggccaagttcaagaacagcccaggcaatatggcaaaaccctgtctctacaaaacatacaaaaatcaggcaggtgtggtggtacgcacctgtagccccagctacccaggaggatgaggtaagaggatcactggaccccagaaagtcgagggtgcagtgagccaggatcacaccactgcactccagcctggatgacaaagcaagaccctgcctatttaaaaaaaaaaaaaaaatggctaaaatggttaattttatgttatgtgaattttatttcacttaaaaaatataggcaaagaataccggaatataatgtgcacctcctagaactctgcctggcgtatgataggtactcactaaatacttctgaaagacttaacaagaacctgctataaaataaccaggcagatccaaaaaaattcaaatgtaacttttaaaaataaaaaacattccctgtgaaattaaaaacacaataaataaataaagcaacaaataagacacagctaaatacaggatttttaaactagaagatagttatgatgaagttacttagaatgcagcacagagaaacaaatagatggaaaacatagacaaggttaacagacgtggaaaatatgcctcttcagagtcctaaaaagacaggccaggccgggcgcagtggctcacgcctgtaatcccagcactttgggaggccgaggccagtggatcacctgaggtcaggagttcacaaccactggccaacatggcgaaaccctgtctctactaaatacacgaaaattagccaggtgtggtggcacacacctacaaccccagctactcgggaggctgaaacaggagaactgcttgaacccgggaggtggaggttgcagtcagccaagatcatgccactgcacaccagcctgggcaacagagtgagactccatctcaaaaaaaaaaaaaaaaaaaaaaaaaaagaaaagacaagctaaagaaaatgagggagaagtacaataaaagagataactaattttccagaaaaaaagacacaaatccacagatatgaaaggaaaagatataccaagctggataaatagaaatctacacctagatactgtaactgctaaacatcaaagaccaaaaaaaaaaaagatttaaaaagtagccagggggcggcaggggacctacaaaggaacaattagactgagagctaacccctaaacaaaaatagaagccataagacactgcagcatagtcaaagtgcaagaaaatagctgtcaacccagaattgtgtacccagcacccaatgattatagattatacatttttctcaaacacagaaggagcatgtacaaaaattgaccacacagtagatcttagtctcaacaaatttcaaataatcaccaccattgttgattacaatgcaattaaattagaaataaaaaagacaaaagtatccctgtttccctatacacatacctctacatcatatatcaaagttaaaaaaaaattggaaactaaaaaataaaaatttcttagaaatgaataatgaaaatactgcacattaaaacgtgaaatgcaactaaagcactacttacaactgagtatttattgactatttttctgacttaaagacagaaatagcaaaacaagtctcaaaaaagtaaaagttggccaggcttggtgactcaccctggtaatcccagcactacgggaggccgaggcaggcagatcacttgagcccaggagtttgagaccaatctgggcaacatgatgaaaccctgtctctactaaaaatacaaaaattagccaggtgtcatggagcatgcctgtaatcccagctacttgggaggctgaggcaggagaatcccttgaacccgggaggcagaggttgcagtgagctgagattgtgccactgcactctggcctgggagacaagagcgaaactctgtctcaaaaaaaaaaggcagagatggtataagaaaggaaaatttcaggtcaatctcattcatcatcacagatacaaaattcctaaacaaaagccaaaccccacaatttactttaaaagctgtggcaggggtgggcggggttggggggtggtagtttctatacaagcaatgcaggggtagtttaatattggaaaactataaatataactcaccttagtaggtctacagaataaataccatgtgtgatggttaattttttaggtcaactagatttggccagggagtgcccaggtatttgatcaaatatttttctgggtgttcctgtcaagctattttcggatgagtttacaaccaacagactgagtaaagcaagccaacctccctaatgcaggttggccatatccaatcagctgaaggcctaaagagaatgaaaggcaaaccctaacccccacaacaaaagaattcctcctgtctgtcttccaagttgggatgtcaactgttccctgccttcagacttgaactgaaacattggctcttcctgagtcttgagcctgccagccttagaactataccactggcagtcctggttcttgcacctgcatactcagactgaaactgtaccattggctctcctgggtctccagcttgttaactgcagatatgatcttgggacatgtcagcctccataaatgtgtgagccaattctttacaataaatctctttttacataccacccccaccataaactattggttctgtttctctgcagaacccaaaaatactgtgtgaccagattgataaatgcaacccctgacccaaaacaaaaaccatctgctaaaattcaaaatccattcatggttaaaaaaataaagaagcaaagtttaaaacataaaaaactactgtggacttcctacttaatggtaaaatgttataaggcttttttttctttaaatcaagaaggcaagaatgcccaaaatcaccatttttattcaacttcttagtacagatcctagactgcacattaacatggaaaaagaagtagtatatagtagttcccttttatctgcagaagatatattacaagacccccagtgaatgtctgaaatcacagatagtaacaaaccctatgttttttcttatgtatacatacctataataaagtttaacttttaaattaggcatactaagagactaacgacaataattaataataaaatagaacaggctgggcatggtggttcatgcctataataccagcactttgggaggtggaggcatgagggttgcttaaggccaggagtttgagacaagcctgggcaacacagtaagaccctattctctattaaaaattttaaaaaatagataaattttaaaaactagctgggcatggtggtatacacctgcagcccagctacccaggaggctgaggtgggagaatcacttaaaagacaagtagttcaaggctgcagtagctatgatcacatcacaccactgtactccagcctgggcaacagaatgaaatcctgtcctcccaccaaaaaaatagagtaactgcaacaatatataataataagggttatgtaatgtggtctctctctctctcaaaatcttattgtaatgtactcacccttcttatgatgacgtgagatgatgaaatgcctatgtgatgagatggaagtgaggctgatgacatagacattgtgatgcagcattaggctactactgaaaactaatttaaaacttattaattatttctggagctttccatttagtattttcagacaacagctgaccacaggtaactgaaactacagaaagcaaaaccaaggataacaggggactactataaagatgagaagaaaaaaataaaaccaatctaccttccagataatgaattctatatagaaacccccaaaaatgtacaaaaataaacacttcattcaaatttcacattgatctgcattaaatcaatatgtaagtatcaattacatttctatatatacaagaaacagaaaatgtactaacatggaaaatactattcacgggccaggcatggcggttcacacctgtaatcccagcactttgggaggttgaggcaggcagatcacttgaggtcaagagttcaagaccagcctggccaacatggcaaaaccccatctctacaaaaaatacaaaaaaaattagccaggtatggtgttgcacgcctgtagtcccagctactcaggaggctgaggcaggagaattccttgaacctgggaggcggaggttgcagtgagctgagatcacaccactgcattccagcctgggtgacagagcgagactctgtcccccgcccccccccaaaaaaagaaagaaaatactatttacaaaagcatcaaaaaatgtaagacagctggggataaatctaacaaaaaatgagcaagactagtatccagaaaattctaaaactctattaaaagaatacactaggctgggcgcagtggctcacacctgtaatcccagcactttgggaggtcgaggcaggcagatgatgaggtcaggagttcgagaccagcctgaccaacatggaggaagtcccatctctactaaaaatacacaattaaccaggcatggtggagcatgcctgtaatcccagctactctggaggctgatgcaggagaactgcttgaacccaggaggaggaggttgcggtgagccgagattgcaccattgcactccaacctgggcaacaagagcgaaacaccgtcaaaaaaaaaaaaaagaatacactaaagaaagggcgagatggccaggcacggtggctcacgcctgtaatctcagcactttcagaggccaaggcaggcagatcatgaggtcaagagttcaagaccagcctggcctacatggtgaaaccccatctctactaagaatacaaaaattagccgagcatggtggcaggcgcctgtaatcccagctactccggagactgaggcaagggaatcacttgaactcaggaggcagagattgcagtgagccgagatcacgccactgcactccagcccagcaacagagcaaggctctgtctcgaaaaaaaaaaaaaaaaaagtcaatataatcttatttcgtgtatcatctccctgggtgaaaagaaaacttccctggatttctacgtgccactgcaaaaagtcctagccttctaatatacaaaaatgtatatgatataaagataagggaatgtttgctttcatatcccccacaaatattttactcttcgcataccttaagatttagatctgtagtcatttatctagttaattgctctgctccacaataataaaacttattttatctccctgagagcatcaagtggggtagattaagagattacagcaaagagaggttcctaggttaagtccagaggtgccaagaagactatggagatctccctaagcatttacatttcaatacagaatgagtttccaggaatttggaaatgtctcttggtccaagagggctaaacaaatggctcctgaagcgattttatttatataccaaagagttggagttaatattcataacatttcaaagagacacattcaggatagcagggaatagctgcctcttcccttttataagcaaatagaaagtatttgtccccatcttttacctatgtagtatgcagctactcaggacaagtggcttaggcctgcatgccctagggagttaaggactaaggcaaaggagggccaatacatttttacttactgtggggtattcacaaaatctgtctctgattcagaaaaccttgtgtgcatttcttggacaaaatttaaaaatcagtattcctcaatgcactgctcattatcaagaaaactatgaataaagtagctatagacggaataatcccagtgaggcctgctggaaaacggatagctacacaaaattcctaggtacattagattctgggagtgtatccttgtagaatgctagcaacctttaagatctaggattttactttacttcttgattctggaaaagatccagtcttccattaacataatgtaatacttggtcaggtgaggaacgaaatgccatctttcctatcctgatcctcatatcagtaaccgaaagatattgtaattttctgataaacccctcattgtccgaattctcaatactcactctctgaaacacaagaaccaaatagatttgtgtaactcagtatctctccatatccaaacctactatctcaactttcactttctgaacttgggaactgaatagattttgatgatgaggaatgcttgcattgtagtcaggctttcagaagaaaacaagccatgtaatacaaacataaaattatgttcatatgcagtgagaaagtaagaaggaagggccaggcgcggtggctcacccaacactttgggaggccgaggcgggtggatcacttgaggtcaggagtttgagaccagcctgggcaacatgataaaaccccgtctctactaaaaatacaaaaattagctgggtgtcgtggcacatgcctctaatcccagctactcgagaagctgaggcaggagaatcgcttgaacccggaaggttgaacccggaggttgcagtgagctgagactgtgccactgcgctccagcctgggcgagagagtctgtctcaaaaaaaaaagagagagagacagagagtgagagagagactgtgtgtgtgtgtgtgtgtgtgtgtgtgtgtgtgcacgcgtgtgtgttttaattctaggacatttaattgaaaggtttctagcctgtaagtcaaagactcgcaagggttttataactctgcctggaagttttatgtcaatctgactatcccatctataaacaacagactgattaagcacatatatatgaaaataattaaattctatgtagccattaaacatgaagttgcacgttctgaaactcaaagatatttgactgccattcgactacctggaaactgaggctcaacaaagtgagaagtaaaaagtcaactgttgtaaaacttgtattaaatggcgcacctatgcaaaaaagttgtatccctctttcttggaacttacgaccaccatttagcaagacaaaaagaaaccttggaacagccacttcccttctctccaaccacctcctcgccttcagctaaaccacatatactggcatcacattcattttccattcacttctcaacccaccacaatctgatgtttgacccaatccctctacccaaactagatatgcttcagtattaaattggaccttacctcagaaatatcccataaatctgtctcttcttgtatcattaccttgtcatcccacccgccatcaccctctaatgtaatagtttctacctcatctcccctcaatttattctcgagtaactaacgtaattattcaaaacacagatcttatgttgcatacactttcaaagtttcaatgcacacccttgaaaatccttcaaaatctgctgctcttaggatcaaatccaaatttccaaacacttgaacactgcctgaatgacgctgtatgacacaggtccctactactttcccccaactactctagtgttcctttatctcctcaacctcactgagtttattgttcttggattttcttttttcttttttttttgagatggagtctcgcttttgtcactcaggctggagcgcaatggtacgatcttggctcaccacaacctcttcctcctgggttcaagcgattctcctgcctcagcctccccagtagctgagattacaccacaccaagctaattttatatttttagtagagacagggtttctccatgttggtcaggatggtcccgatctcctgatcttatgatctgcctgccttggcctcctaaagtgctgggattacaggcgtgagccaccaacgcccggcctgataatcacattcttaatcacaaagtataataaagatattccatgggggctgggcacggtggctcacgcctctaattccagcactttgggaggctgaggcgggcagatcacgaggtcaggagattgagaccatcctggacaacacggtgaaaccccgtctctactaaaaatacaaaaatcagctggctgtggtggtgtgcacatgtaatcccagctactcaggaggctgaggcaggagaattgcttgaacccaggaaggcggagattacagtgagccaagatcacgccactgtactccatcctggtgagacagcaagactccgtctcaaaaaaaaaaaaaaaaaaaagatattccatgggaaagactggtttgcacaagctccaataccatggcccaaataaaagaataccagaaccacagtaaaacactgttaactaaacagcagcaacagacagacacctcatggtactttcagaggcaaaaataaactgaaacactaatatgatcacacatgaatatgcatatttgtaacaaagaatgagaaacattaaaaaacttttcactcacaagtttttctctgtctagtttttgcagtaaactctccatgttacttccaattcttgtcttttccacaacttcataaaggctgcaatacattccattcttcaaaactgacataagaaaaatacatagtaaatatccaaatcaagtctgcttctaatgcatttcaataaaattaaattaccttaccttcatttggacctaagtatgtttccttataaaacagtgctggagggattttctgtttcagatgatcaatactcataactgtttcaacatctaatttctcaggtctgaaagaaaattttaaaaacatgtttgccttatctgtattttcaactctagcaatcttaacacatacacaaaaaagtacacttgatggaaaatagaagagcatatctacgaatatctcaccttattctaaagatcttttgtttcgtttgtgacagtctcactctgtcacctaggctagagtgcagtggtgcgatcacagctcactgcagcttcaacctcctaggatcaagtgattctcccacctcaacctccagggcagctgggactacaggcatgtgccaccacgctagggtaattttggtttttttgggtctttttgtagagacaaggtctccttacgttgctcaggctggtctcaaattcccggtctcaagtgatcctcccacctcagcctcccaaagtgttgggattacatgagtgagccactgtgcccagcagtaaaggggatttgatactggaagtccagatatatacatgggtagatagctagccaggcaatatttccaaccttccatccttaagccagaaactaaaaggctgtcattttattaaggacaactgaagtataaactgttaatcttcacatgtttataaaggcccacaatgatggaagcaagagattttagacctttctataccaacatatgctgcataggactaaaaacagcctatatattttaactcaccaaatcaaagctcttcccaacaaagaactggtaacttttaagtctactatattcaaaatgctacataaaaaaatatatctacttagaataaaactaaaaaattatatttcagacttaaatcactaagaaaaagttttaggctgggcgtggtagctcacgcctgtaatcccaacacttcgtgaggccaaggcgggaggatcatatgaggtcaggagttcgagaccagactgactgacatggcaaaagccccgtctctactaaaaatacaaaaaaaaattagctgggtatggtggcaggaccctgtaatcccagctactcaggaggctgagatgggagaatcgcttgaacccgggaggcgaaggttgcagcgagccgagattgcaccactgcactctagactgagtgacaagagcgaaactccgtctcaaaaaaaaaaaaaaaagataaagttttataccgtaaatgtactgactagcctatcctcaaatcaagacagagacgtagaggactcatattgccaaatcacgtaatttcaaatcaaccatttaaaaaacaaaccaacatttatattgaagttcttatgaaccaaaataaaatttaaatatgaaaaagaaataaggaaaaaggctcaagaaagtgataaaattagcaaccacgaactgctctttacttatacttacagtttgataggcaaaaaagcacgagtggctgacctcagagaaatataacacaaaagttttcctttatttaaaagctgtcctttccacaaggtatagttatatttatctaaataaaaagaatataatgacacagcttagtcacttggcagcccagagaagtgagtgcacatttattagaaatgagacggaaaatatctagaaacaaggtttaagtaggagggcaaaaaaaaaaaaacagtgactcttctacacttctatttactaacagttcaaatattaggatttttgtttcaggtatttatcccctacaaaatcattccagttgcaaagaataacaaatgtatctgtctaaatgtcattatcagaaaagttggggagcaaagacaagataattattcatctcttatttcctccaaagggacactgtatgaaatctggttgattatatgaatgcctacagtgtcctgtatcttctactcattgtgttttcattataaagaaactttaaaataggctgggcatggtggctcacacctgtaaccccagcactttgggaggccgaggcgggtggatcacttaaggttaggagttcgagaccagcctggccaacttggtgaaaccccaactctactaaaaatacaaaaaattagccgggtgtggtggtgggcgcctgtaatcctagctactcaggagaaggctgaggctggagaatcgctggaacccaggaggcagaggttgcagtgagccgagatcacgccactgcaccccagcctgggcgagagtaagactctgtctcagaaaagaaaaaaaaacaaagaaactttaaaatagtttaatgtcaatgctactttcaatcttctctaattctaagtcctacacctctggtgaatttaatacttttaaaaagctgagttatgaaacctgttttattttttatctttttctattaaagtgctaaaacctttcagtctattcacagtagcagattttcaaaggagatcttatgcttggacaaccaaatgcgctgatgctacattataacttttcatactttgcagattttcattcattataaaaataatacaaagcacttaatcttttgctatatgtacttattctttccatttataaaactaaagaaacataaatctcttacctatgtttctatctgtattaaagctgttagatctacaaattttttaaaagaaaagaaaaacattactcattagtataatcataaaaattaacatgtaagatgatataagtgcaatttttaatggcatactacagttaagtccttcctccaggtaggaagaacaaagaaattactcattacaaagtctagtaaatccaagtctacttagagaaaacagaagtacttacttcgctcaaattaccacatttacccaaatttaagggagttgttttttccaaaaatattaaccaagagagaacagtgtccaccaaagtctcttgtcaattattttgctgacattagaagacacagcctcaatatataaatatattaattcatcattcagtaaatacatactaagctcttatttaccaggcacagttctaggtaataggattatagagataaacagaacaaagttccaacctacataaatctaatgaggaagacagaaaacaatgatatataacagatcatgatggttttcagtgctataaaaagagacataagagtatagaggtaaaaaaaaaaaacagagaaacctcaatcataaggaaatacgtgaagaaatgtagaatgaattatgcagcttactggggaaagtgagagaacagcaaatgcagaggccctgaagcaggagcattcatggaatattcaaggtacaaggatggatgttcactcaatgctcctttgaaatgatatagaggtcaagagatggaatcaaagaggaggcaaagaaattaacagtcattattcctgggggcatgacctcataattttaagtgctggatgtcttttaaagagtacttatgaaaacactgtagtgaaagtatgtatcacagtgatcataaatttagagccacaaaaaatgaaagccacaactgtctggatactatgtcaattggtacctgtggctatagatggtttccaaggattattcacctacataaaaggaccgtaaatggaagagaagataatttgatctggaaaactgacaaagaggtcaacctcaaaaatgtacatatatgtttcatgatatatggttttagaacagcagtatttctaaattaatagatatcatacatgacttcaaatatgtatacacacccaaagtaaaaaatgagcagacatttgaccatctcacctacatccctataaatatacttattccatttggctaaagcatttttagaatcaacacatggggaaaaaaaatggtaactgcttcctatttggtcaccttatactagagcttttaagaaatactcagtaacacaagaacagaaaaccaaaaaaaaggaaagaaatcatcaggccaagtgtggcagctcatgcctataatcctagtgctctggaataccaaggcaggagaactgcttgaggccaggagtttgagaccagcctggccaacacagcaagacccatttccatgaaaactaaaaataaaccagacatgatggtgcatgcctgtagtcccagctacttgggaggatcgcttgcacacaggggtttgaggctgcagcaagctatgactgcaccgctttactcactacagcctgggcaacagagcaagactttgtctctaaagaggaaaaaaaaagaaacagagggtcctcaacactggctgaaaatcagaatcacctggaagcttttaaaaactatcaatgccttgactgcccactaaatatttgattggtttgtggtgaggcatgagcatcctttgtagaagctccccatttccaagggtgctaatacacaaaatctcacttttttgttgttgttgttgtttaaatacagacgaagtcttgctctgtcacccaggctgtagtgcagtggtgcgatcacagctcactgccaacctccaccgcccaggttcaagcgattctcttgcttcagcctcccaagtagctaggactacaggcacgtaccaccacatccagctaatttttttgtagttttagtagagacacagtttcaccatgttggccaggctgttcttgaactcctgacctcaggtgatccacccacctcgtcctcccaaagtgctggaattacaggcatgagccactgcgcctggccaaaatctcactttttaaaactgccacttactggccaggtgcggtggctgacgcctgtaatcccagcactttgggaggtcgaggcagtaagatcccgaggtcaggagatcaagaccatcctgggtaacacagtgaaaccccgtctctactaaaaatacaaaaaaattagccaggcatggtggtatgtgcctgtagtcccagctactcgggaggctgaggcagaatggcgtgaacccgggaggcggagcttgcagtgagccgagatcctgccaatgcactccagcctgggggacagagagagactccatctcaaaacaaacaaaacctgccacttactcaactacacaaaccttcatttctaaggaagagattagcgagatgaggtttaaattttagcttgtatttatttccacatggtaaactgtctgttcttcacaccgaccatttaaaagtcattgtaaacacttcagtctccaaccaacttcaagggaagttaaaaaaaaaaaaatgggaaggaaacaaaatggtcctcctaactcagtagtacaggatctgtagtagaattatcactgcggatgatgtctaaaactcctaagtcttaccttgatgaaggtacaaacttcggagtttgtatatcatctttgtaagtaaaagacacaactgcatatggacaaacgtgtcttggtcttcgccttagctcatcaaagccatactcataaaaataatactaaaaataagaaaatgaaaaattaacttctttaaaaaggcaaggtgaaaccttatatttaactgcctgatttctgagaaatagaaaaccatatatgcacttctgacaaaaaatgtctttaagctctgcgtgccaatttaactaaaataattagtactttgtattcattttgtgatataaaatattctgcatctaagtgcgtaagatcccagagtattactaactattccaaaagtttacttctgaagagttgaccaccgggagtttcctaataaaaatattataaacagagcctaagctcccaggtcagctcagaatagccaatctaatacaaaaagcaaaatactaagaacacaatctcaactaaaccaaactatggttttgctatttcaaaagaaaaacacacctgggctccaattgcaaacaaagtagcaaagggagatacggaaaagaatctgaacataggtgacaaagatagccttccctcttcccattacccatcagtctttccccttcacctcttcaccacattcagtatagtacagttttgtaactttcagagtagtgattttcactttaagaatgcctgagtttatgaacaaagtagtacagttcttcaaagtccattcccctgggaaactattgatttcaataatgttgttattgctctaaaaatggctggagtttttaaaaaacgtaaggccagtttgcaagtccttctagaaaagccaataactatcttacatgtatacttcacacctaccaatattgctactgtccagagggtaatcaaatgagtcagtcccaaatgactttggtgaatataatttttgctaaaagcccacaacaatagttcttaaaattttattttacataaataaagcaaaaattaaagaaagaacatttccagggaagttaacattactacttttcacaagcagtctatttggttatagacattttttttaatgttaaaaagaacaggtgccgggtgtggtggctcacagttgtaatcccaacactttgggaggctgaggcagacaggatcacctgaggtcaggagtttgagaccagcctggccaacatggtgaaaccccatctctactaaaaaaaatacaaaaaattagctaggtgaggtggcaggtgcctataatcccagctacttgggaggctgaggcaggagaatcatttgaacctggggggcagaggttgcagtgagccaagatcacaccaccacactccagactggacaacagagcgagactccgtctcaaaacaacaaaatactaataattaaaaaacaagaatagggaggccgaagtgggaagatcacttgagcccaggagttctagaccagcctgggcaaaacagggagacccccatctctatttaaaaagacaaacacaaaaacaaaaaaccattgctttatagtcaaacctcatataaaaacttaacactaaagctcatcaaatgttactcttatataggtgtagtatatgtcaattatacttgaataaggcttaaaaaatagttctaggtttgcatctttaaaaatgttaataaagatagaaaatacctatcaaatcaatagtataaaatgttatgcattaagattatttcaaggggtttcaactttaccttgaaagatgagtagtatcttattaggcaagagatctttctaggccaggaaatgccaaggtttcaaaatgaaatgaggtgtgttgagggcaatgatcatataaaaaccaggtcacagtctactggcaggaagagctagactagggagtctataaatattaccctgtaaccttgaagacccactgcatgtttctgagacatctcagaaaacactgaacaaacagcagcaacagacactggagtctggaagtgatatgcagacaccagagtctagactaatgtggggacagagagaactgaaagggagacattttaaaggatttggtaacaaacaggtatgagatcacaacattacaacggatcctggaacctacctgagtaagctcataggctctgtaagccaaaagtgatgtaattcgattggcattctttgacacgtgacattcatgctttggtgtggggtccaaagcactcttatttaacatagattccaaactttttacacccatggggtcatatatactctttattttaccctaaaatagagaaaaccttttaagtgtctacctaaacctaattgttgactatataacattaatattatgaaatacttctttgaatatagatcaactatcccaaccattttttccctttaatatctcacagaacagctgggcgcggtgactcaggcctgtaatcccagcactttgggaggccaaggcaggcggatcacctgaggtcaggagttcgagaccagcctggccaacatggcgaaaccgtctctactaaaaatacaaaaattagcagtgcatggtggcgcacgcttttaatcccagctactcaggaagctatggcaggcagaactgcttgaacctgggaggcggaggttgcagtgagccaagattgtgccactgcactccagcctgtgtgacagagtgagactccgtctccaaaaaataaataaaataatatctcatagaacacttttaccaaatttgaagcagtaagaaaaagctaatcactaaaagaaaaaaaaaaaatcatttgaacttgtttaataacaagtaaatagaaactccattcataatactcttcactaatataaatcatattaccaacatattactctctacattcctttctttggaaaggaaaacaaactcttaagtacggttagcttagctcaaagatggcaaataggccaggcgcagtggctcatgcctgtaatcccagcactttgggaggctgacgcgggtggatcacgaagtcaggagatcgagaccatcctggctaacacggtgaaaacccgtctctactaaaaatacaaaaaattagccgggcttggtggcgggcacttgtagtcccagctacttgggaggttgaagcaggagaatggcatgaactcgggaggcggagcttgcagtgagccaagatggcgccactgcactccatccagcctgggcaacagagcgagactccatctcaaaaaaccaaaaaacaaaaaacaacacacacacaaaaaaagatggcaaataaaccattttcaaaagtatctttaagtaccaaacactaacaagcatgaacttttaaacaatctcctaaaaacagcatcatctaaaaattaaaatccaaatcaagtgtagtttttcatacatgaagtgtgtaagtttaaattaccttcattattttaaaaataacaacatcacccattgcccccgtgtccaaaggattcgcttgtaataaatcagcatacctagaaagatagacacctagaaaagacggaaaaattaaggaaactgattatatttttcaaaatcactaggactaaaataagacatttttaagaagttatccttcatcaatttgaggtgttcaaaaatcagaaacaaaagataaaactgatcttacatttcagaacctatgactagtctttttctgggaacataataaagcatgaatttaataacaactgcagtgaaattacgagacaatgtatttttagacagcaacttagtagtagatatttatatttaaaaagaaaaaagattacccatggaaggactgccaagaattgttattttggactgacccacatgtaatcctttttcacatatggtttgaacctaaatttaaaaaaaaatacttcatcttgcagtcataacaacatttaaaacatgaaaaaataattttataaacttggtttaaataaaaacaaagcttcttaactatgtatcattctagatcacagaaatcttatatatttgccactttataaatattaatgtaaaactgacttacacttctcaaagtaaccatatctagaatccatttttcttcattttaatttttttagagatagggtctccctctgccctctaggctggagtgcagtggcatgaccttgaactcctgggctcaagtgatcctctcacctcagcctcccaagtaactagaactacaagtgctcaccaccatgcctggctacttttcaatcatttttcttcatgccaggtgtgacagatactcttaactcctgccactcaatatatataaccaattcttttcaaagagaattagaaacagcaaaatattattccacctaaatatcttcgattaaaaggggaaaaaacagaccaggcatggtggctcacgcctgtaataccagcactttgggaggccaaggcaggcagatcacttgaggtcaggagttcaagaccagcctggccaacatggggaaaccccaactctactaaaaacgcaaaaaaattagccgggtgcggtggcgtgtcctgtaatcccagctactcgggaggctgaggcacaagaatcacttgtatctgggagaaggaggttgcagtgagtgagccgcgatcacaccatttaactccagcctgagcaacagagtgagactccatctcaaaaaaaaaaaaaaaaaaaaaaggaaaaatggttccaggcacatagaatcaacaatatagaagataatctcacatataatcaacaatatagaagacagtcttcttaataaagaaaaaaggccaggcgcggtggctcacacctgtaatcccagcactttgggaggccgaggtgggtggatcatgaggtcaggagttcaagaccagcctggcccacatggtgataccccgtctctactaaaaatacaaaaattagccaggtgtgggggggtgtttctgtaaccccatgtacttgggaggctgaggcaggagaatcgcttgaactcaggagacagaggtcgcagtgagccaagatcacgccactgcactccagcctgggtgacagagcaagactccatctcagaaaaaaataaataaataaacagaaaagtattattatcaagcacattctaggggaagaaaataggactggtcagagaaaaaactgagtacatttgaaaaacaaattacaaacaataaacattttgccccattaaatcatgtattccacttatatatcaaaaaagtctgtaattgtaaagaatactgttgaataatcacaaaattagtaacttacaatggaaacatccccaaattgttttttataaaatgcgttaactcacctggtatcgatcaaccatcagaaatgcataggattctgaaagttccttatctaaacgaccatcaaacttcagttctcttcgcttttctgtaaactaaatgaaattaaaactataacaactacttagcatgtgattatgtttttcaagctacaagttttatttttttttccaagaaatctcacacctaccaaaatggaaaaataatctctatctctctatactctctgtccttcagtttttcccctattttaactggctctttatatataatattaatatagtcaaataaacatctaatgctcaccaatctttaaatttatcttataattttaccacattccaactctcccatagattataaattcatgctttaattatctttgtatcttccattttacttaacatggtacactgcatccaacaggtggtttaataaatctgctgaatgaccaacttctagattataaactcaattaggacaagaaaaatgcttcttttctctgtaactgtattctcaatgccaagcacataagatgtgctccatacatatttataggatggaagagtgactttttctaactagttggaactataagttatcctaaaccactggctttcctatctataaaatagatatgcatttaaaatataaaatagctaacattttatattcaggctattactgctctttaataactaatttatcttcagactaaattttcatatgaaattaacaaataatcgctaccataccatgaaaccacatcaattcaaactactaagattttaattttctctgggattcagtgccctttagggaacctttcaaaattaaatcctggtaccacttggttaaccaacttgcaaaaataaaaaattcgtatttcaggtccatcggaaatcattatgcatcaaatatttcaaaacatctatacattctggcttttcctaaatcaaaactcaaatattctaatttgtacatgaaacttaagttcactgtctaacatgctcaattattcttctttgtttgaactttttcactaagaatatgtactaatgataaaatcctaatatagccaccaggcaataattgtggaaaaaatgaagcatgtcctaaaaacaaacacacccatatatttgacttcattaattaccttccaatttaggcatttaattaacatgtacaatactcaaagagcaaaaagccctactaattcacaatttatttatttacttatttatctgagacagagttcttgttctatcacccaggcttgagtgcagtggcgcgatctcagctcactgcaacctcacgggttcaagcaattctcctgcctcaccctcccaagaagctgggattacaggcatgtgccaccacgcctagctaattttcgtagagacgggttttgccacgttggccaggctggtctcaaacccctggcctcaagcgacccgtccacctcggcctcccaaagtgctgggattacaggcatgagccaccatgctcagctgaatttacaattgaaccattagctagtaagctatctctacacttaagattttcagttaaaaagttattttacataattgcatattagtaacaatttaacacagcagataaatgtaatgctacagcaacatctggtggaaaaaagagatgtcatttaaaacttgttttcccaattaggcaggtgcagtggcacatgactgtaatcccagctactttggaggctgaggcaggagaactgcttgaaccagggaggcagaggctgtagtgagccgagatcgcgccactgtactccagcctgggcaacaacagtgaaactccgtctccaaaaaaaaaaaaaaaaaaaaaaaaacttgttttccctttgtaatttggttttcctaaaaattttagtatttctagagaacatttttttcccaggctgttaactggttctgaaaacaatcttacagtaagtataatttaaaacatacctccttttccaaaagctcattgtgtaccaagcaagcacgtctgtagttaaaatttgttactgaggttggttcaaggtaagaagaatggagaatatttacaacatcttcaaattctcgagagcctggagttaatggctggaaaagtgctaaaataaaaaaacaaacatttaaaatgtttaacattactccatcttaaatatagctttttatatttttgtgggttaatgtaactttaaataccatgaaaaaaggcatcaaggctatcttactttgtgatacgcaaaagagatacttattaactcattgaaaaaaaatgtaaaactagttgcctacatacaccagttccttcaacaatgaggatctggcattacatacatagacaaggaaggtgcaattttgcaaaccttaggcatgctatattaggcaacctaaattgcttaaagactcttaaaagaacctgtgtttatactcaacttagctcctattttatgttacactgaagtatgtctcagactgtgtatttcagcaaactacctataccatgtatgagaccataaaagcatttaagacgttatgtgaagtaacaaaatatgctgttactgacacactggtctttaagtttaaaaaaaaaaaaaaaaaaaaaaagcttggtggctcatgcttgtaattccagctctttgggaggccaaggcagcaagactgcttgagctcaggagttccagagcagcctgggcaacacagtgagaccctgtctctacaaaccattaaaaaaaaaaaaaaattagccaggcatggtggtgcatgcctgtagtaccagctacttgggaggctgaggcaggaggatcctttgagcccaggagttcaaggctgcagtgagccacgttctcccaccgcactccagtctgggagtgagagagagaccctgtctcaaaaataaaaataaaaaataaaatgctgcactcacgtggcttcttgtataatccacaaaaagtagtagaacatttattatgacaacttagtaaaatgaaaacatgtggggctttagagtcaaagctggacacaaataccagacctagcattactggcttggagtaaaatgcaggtaaataaattacttatatagctcagctctctcatatgtaaaatggcaaactccagctactctaataaccactatatgccacatgccacactagacaacacgtggaaaaagctctaagcatagcatctgacgcatagtaggacattgtttgttttgagatggagtctcgctctgtcacccaggctggagtgcagtgacacaatcttggctcactgcaagctccgcctccaaggtacacaccattctcctgcctcagcctcccaagtagctgggactacaggcacccaccaccacacccggctaatttttgtgtgtgtgtgtttttagtagagacggggtttcactgtgttagccaggatggtctcgatctcctgacctcgtgatccacctgcctcggcctcccaaagtgctgagattcaggcatgagccaccgtgcccagccaggacatttaagtttttatcctccacatccccaaccattctacatcccactgaattttttttttttttgagatggagtttcgctcttgttgcccaggctgaagtgcagtggcacgattttggttcactgcaacctccgcgcctcccaggttcaagcgattctcctgcctcagtcttccaactagctgggattacagatgcctgctaccacgcccagctaatttttagatttttagtagatatggggtttcaccatgttggccaggctggtctcgaacccctgacctcaggtaatccacctgcctcggcctcccaaagtgctgggattacgggcatgagccaccgtgcccggtccccacttaatttttaaaacatttaaatcaactatgcaattagttcttgagaattactggtctagtaacctcaaatttccatcttatgcacaaaatactttaatttactaatacacctaaaagtctatacatatatatatttccccaaatcaaaaaggaaccacttttcactgtagagagaactactcatagaaactatgttattctctattaccttaatttctttcaagacactatttaataagggtcaagaatgtaacagtcaaaacaggtcactactgaaaacataatgttccacttgtacatactcctaaaggtaacagatgcagcgaaccgttatcttttttatacatgattattagactttaaaagacatgtcaaatgacagagccattcatccattcatttaccaaagcatgtatatattacataagtgtctgtaaaaacgtagttttcaatggcacaatgtgtacaaacaaatggttaccactattttcgaactgtgcacgaaaaaaatagtcaacagttatagcaatacaattaaaaaataaacaggagtaagctcaaacaagtactcaaatagaacaagactactcaacacaaagtgtcctataatcaaacttgtagcagacgaatatgctcggtaacctattgattgtaagctccatgagagcaggaacctgccttgctcattactcgtgtttcccacatcccagtagctagacctgtgagtgccagccctaaatatattaaatagtcaagaaaatgagaaattttgtcaagagctttaaaaatggtaacaatatattctactactaaatgactgtgatttaaaattgactctttcacaaattcaacaattcagtaatatacgaaacacaaatgaaagctcagaaaagagggtagaaggcatatattgtcttcattcaaacctgtgttatggaacgtaggacaaaaacatcttatctttgtgataattgtccccaattaaactgtgaaaaacttggcaaggaaagcagcatgtggaggtctttataggctttcacaaccaaagtgggccaagcatgattttaaaagttgggttatgattttaaaagttgggttttacacgattttgtttctaaacaaaatgacttcagatatataaaatgtacacaaaaaaaggtatcacatggctgccaatttctatgaaatgttagtctacataaaagaaattttcattagttaagctacccaatacaatttctaccattaatctaatcgtaagtaaaaaattagtcaaatcatgaatctgcataaaagttcacatccaaattattctcaaagtacttaacatttccagttgactctaaagcaatgtccaagtcatgtccaatgtactaaaaatgacagctgacaggaaaaaaattattgcaaatgaaaaggaaaaagcattttagctttaacaataaatatctgtatcctaattattttgtattgcaaatgcctcagtggcttcgttaggccggttataatttctcattttttctggtgataatttctaagataataaaattatcctgcaactatttttaaggatttcaagtcaacttgctgctaacagcagttcagaaaatttattaagttcatgttctgaatgtacattttctggtagtctattttatgtcctcagaggtcatttaacactacatgtatctcgatcaatgtatcctgtcactccttttaaagaaaatatttaagtcaaaaatctcaattatgggtcactatttgaggtagtaataataaacaaccctgtgtctatccaaatagggaaagcattatgtatatgaattatccatttcactcagggaactcagtattcaatacactgttctctagattgacagttactgtctaaccattagtggttaagtaccaccttcaatactgtactaagagctttacatatatcatctcaatcatcaaaactacactatgaagttcaacatgcccgtttctcaattgaaactgagacaagtagccttttgagttggcccaaggttacagggttaatgaatgaatcaagctgctgggattcaaattcaagtggttaagctccctttcttgtatcctgaaatatatgatgtgtgtgtgcatatgggtattagacatacaatgtccaatcatgtcaagagctggaaaaatgactgtttcctcactttatagactagaaatcatatacaacacttagacacaggaagttaatataaaagaacaaagaatttcgttctaatactgctctttctaccttcctatcttctctcaaatttcttaattttttctgattttaattttcctctagagacaacagggccaagagtcgtaacaccctttgttttataaaggttaacagcagtagcaatagaagttctttcacacattaagaaatgtgtaattttgcttatttgatcgatttccattaaatgcctgtcagaagaacagctaagttgattactgatcacacaaggtttccctacttacaaattatagatgtattttacgagactgaagagcagatttacaagggcacttagagatttataattcaaacgaggaaactgatagtatcatagaatttcaactggaattcaaatttcctgactcttagccatactatcatcaaatattttttattactagtatcatacaaaacacacttatgattttttttttttttttttttttgagatggagttctgcactgttgcccgggctggagtgcagtggcgcgatcttggctcactgcaacttccacctcctgggttcaagctattctcctgcctcagcctcccgagcagctgggatttcaggcacccaccaccaggcccagctaattttttgtatttttaatagagtcagggtttcaccacgttggccaggctggtctcaaactcctgacctcgtgattcgcccacctcggcctctcaaagtgctgggattacagacatgatccaccatgcccagcccacactcaagatttgaaggttgtatttataaaggcagtgggcattgatatataatttaggtcatcaaacagctttgttccttaatcaaaagaacatcttcatcaattagttttaccaatttgtttggtgttaaggcagatctttttgtattatgtatacatgtatcacaaaaaatattatcatatatacataaatttaaaaaagctaaacttaaaagacatatcattcctatcaaaacatacaaatggggctgggcgtggcggctcatgcctgtaatcccagcactttgggaggccaaggagggcggatcacttcaggtcaggagttccagaccagcctggccaacatggcaaaatcccacctctaaggagaatacaaaaattagctgggcgtggtggcacatgcctgtaatccgaactactgggggaggctaaggaaggagaatcctttgaacctaggatgcagaggctgcagtcagccgggatcgcaacactgcatcccagcctgggcaacagaggctctgactccaaaaaaaaaaaaaaaaaagacatacaaatgggtcatacgaagtacaaataaacaattgtctgatttaaagtaactaatacatagaagatgacgaaataattagcaagaagaggctgaggatctgaaattttctgaattcacagctgacgcctattaatgattataatacaaccactctccatccatttgttcttcacagtaagatctttttttaaaatcacttttcttcattctaaaaaaaattaccacagacaatactttaggagtgggtacttcatctctacatcaacaaggttgaacatagtgtacaattagaaatgaatatgctggcaggaatcaagagtacaaatacgaaacaaagttttttggactgaggatagctcaaagtaaattttaccttgattactttgctattatgtatggagagagctattgttctcagaacccactcatccatatacaactaatgaaataccatggaaatttccttaagaatgagacttggctccaatgacttcaaaaaggcaagtgaaaattttgtgggggaagatggaggttaggagaattagccattacttctggactaaaccagtatggaaatttagtgcatgagcgcaattaatttttgagactcccttggaccctacaaaaacattaaccaataaacgttttccagaaagtgaatcatcgctactccatttcccaagaactttggagggaaaaattacatcaaatgcaattaccaattttaatttactttttatgactcactagatttaaagaaggcaatagtgaaacatctaccaacaaaatgcaattctacaatttggttaaattctataatttggttaaatgtaagaatcatgcctcagccaataaataacatacatcaaaaacagtaaaatgtatacctttccagtcaaagacgcacttagtatgtcagtaccaaccaaatgttgatagtaaacataatttctgaatgtcaaaattccccaaggatgaaaacatactaaatatttctatatttaatgaagggggggaacagtttttgttactaacaggtcaggtcaaaagcagctaacttaaacccttagattattcaaactgggtagcaagatttttcttttttatagtagtaaaagtactctacaactaccttcaaattccatctccacaacttagctgtgtgacctgaagcaagttacctaacttctcagtactttagtctcctcatctgtaaaatgggaatagtacctaccacaaaacattgttgagatttagtcaatgtatgtaaattgcttagaacaatgcccacaacttattaggcactatacaagtgtttgccaatattattactcaattacaatggcagttattttggatgtcacactactgggaagaccaaaaaaagaactttctgagtcaagttgtatttgcatagcagtgacctttaaggtattaaaatatttaagtcctaatcttaaatttcactggaaaagcacagtcacaagaaaaggtctaccatattaaaatatgaatgcaacagaacctgcactgtttttgaatttttttaataaagttgaatttatgtattaaattctatcagcaaccactaacttctctcagcttgaacaagataaaattcatggtggtaaaatagctgcttatttaattttttaaagttctatttaaatcgctattttactatttgaacagctggtgttcagggtataaataattacacaagttaaaaattgctcattttcactaatcatgacaaagtccactgcgatatattttcctcccaacttttgtctgtaagtaaaaatggaaaatacaagttttacccaagaggtacaagactatgggggacaacagctagatttatatttcctaatccctcaattatttccacttttagtgtgttcagctgaagtctattttacaacaatctctggattttatctaattttaaaaaaacacacaaacacagtgcctttccagttcctactgccttcccacatttcaaactaaattttgaagagtttctaggccaatcttctggtcctaacaaacagtaaaaaaaaaaaaaaaaaaatcacggtttgtccatattcttaggcacttaaaccttaaaaatagatttcaaacggcttttatcaagctgtgaagaaaaaaaatagttccacctcctacctcataaccagagcccatttgaatgtacttcctacctattctctaccaattgattacactgggaacttttctcatacagactataatcatacatctcaaattttaactaaatacacgaaaagaactgagttttgacctttaaaagtatctttctgaaccctaaaattacattaactcaaaagatatttctagaaacattcctcatgctaatttccaaaggttaacttcatctttgtcaacatggtttctcacaccaagtattttcttggctttgccatccaaacaaatgaactttatttgtatttttccaataaaaggctcaaacaattccagtagtgcaaatggaactggtgatgcttatggaaagtcagtataatgctacagccaagactctgtaccagatggatggaaaagatacgggaaaaaaacaaatcctatttttttccaaagtaaataatgaaaacctaaccatacagtagggcaaaaaggaagttgtctaaattcagaatatccaaaatttactggatagttaaaaaataataccccaataacaaaaaacgatactaattttgacctccattaggaattctgactccatattaacaatatggcattaagattttttaaaagtacaagtaattaatgtaactgtttccatatgggttccaaaaactaagactggacttttttttaacctgaagttctaccatctagaagaccaagttggtgactcttgagaataaggtaacttctcattagtttttttccattgggaaattactgctccaagaacctacctttccattcttttcaaatataagaaaaacaatactaagttcgaatttaaagagagaaaaacctatttaatctaacgcttcaaaaacaagggggaaaaatctacatggaaatgaagtgtgatggaaaacagcagtgtgcatggatcacatctactaatagagatttctaaataagggaggacgctgacatcaagcacatttcaagtagacacacagaactgaagaatttccacggggagaagcactcatggtcctcagaacattggcaatggccttggagaaagccccagaatccatggccacgggctatttccatagcgagacttctcagaagcatccttaggaggacacaacggcttctctgctttcaggggctgggagggaggggcgccgagcaccatctttcctctctgggagctgcagccttacggacaagcttcaaacctgagctacttccaacttccgcggggaggggcagcaggggagcgtggttccaccgctttctctcgcaccaaacgcggcagctgggcggccgtggcggtgaggggagaggcggccggcgctgcatgcgtgtttacgtatctcggatgggtgtgggaagaggagatagaaagattctaatgaaaagatggaggggagagagagagggggttgagaagaaggggaggcaccacctttcttttctctgctcttcctggggatctgaaaactcctcctaacaggcctttcgggctcttcggggcctctgggcagggcggccgcgcccgcctcagaggagtcctgaggctgctcgtggctgaggctctgggcggcctcggcccccgcgttctcctcacgcccagcgccgccgctgggctcagcgatgttgaggccgccgccgccgccattttgttgggaggactcaagctccggaagcgcctgcttcatctcgtcgtctccgccgccgccactttcccaactcgcatccgtcggctgacaggcctccgtctccacagcagtcgccatcgcgccggcctaaggagctctgggaagcttctgcccacaaggtcgacgggtgtggggggaaggggcggcgggccagtctcgccgccgagctgctctcagcccacccacccccttccccccgtggcctcaggctgcgctcccgacctggcagcctcttggggggccctgtagcgggcaccccaaatgcgctgcccggtcctcggagccgctcctccctcgggcagttcttctgccttcccccgccactcaacgtgcgcgcgtcggggccgggagggggcggggccaccgcgggccactccaccaatgggagcgcggcacccgcctgcgcgagtgcggaaataccgcgccggggggcggagtttcggggcgcccgagcccgccaaaaggggcgaccgcaacgccccgcgaggacctcgacgccgcagccgtggcctgcggaatgcgtgggcccctggcgatcttcgggttcccggggattcccccgccgcgctgcaggcgagggagactagcttggcctcttctccggagcgcaggcgtcgcccatttgtgggcaaaacccttcctctgcgcacgagttatctcggcccaaacgggcttcagagcagtggatgcgggacgatctcggttttatgaactatttgcatgtgtacaaaaacctggagaggagataaaagaatgggctaggcggtaatagcctaaaagcctcgacagcctttgcgacctgctattctcaccggatcttgtatctttatgatagattactcgcacccggccttctcttttatctcagagagtgtgacccagtgtcacagctccagcaagcactttcacctgagatcctctgatgggacttaacaacctagtgttaacaggatttggttctggggagtttgaggggaggaggctgttaacttttcccatttttttcctttagtcgcacccccccccaccacacgccatggagaccgcacctggcctccatttgttccctttctatggttacttctgttaaaaatctggccactgataaacctctaactccactgtttcttccactggaacgttcatcaacgttttcctatagtaaatgtatattaaagaaaaaataaacttgcggtcacattaaaaaatacacagcaggtcgtcgctctcccataaagggaacaacttcatagttaagagccctttacatagtggtttctaccttatcagtataaactatcacgggttatcgtgagtacagccaatatttactgagtgctttctacgtgctagacacggactggacaagtgatttacgtgcattgtctccatttaatcctcacagcaacagacatgaggtagatactagtttgcagaatttgaaagaagcgttgcaagacactggacaaattatggtaaccgaagatttgaaaccgggtctatttaactctccgagtaagtacttaagcactgcactgactgcttctctaagacctaattttcacagcagctgtgcacttttattcattttatggacgaagcaacagagggctgacattttgttgagggtcgccaagcagcaggatcaggtttgagacccagatctctagtctcaaactgtctcccaaggagtttacagaccaaattatcatcataataaagccccaggcttaaagagcattcctaagggcaacacgaaagttggattcttttgtcctctaataaacattaccactgtttaacagctgatattaaaaaaaaatcatgaattgcccaacctattcgaaacaatttagtaaatcatacgaaagagagtgtaaatccattattagtaaatagtttaaaaacacattttaggccaggcgcagtggctcacgcccataatcccagcattttgggaggccgaggcgggcagatcacctgaggtcaggggttggagaccagtctggccaacatggtgaaaccccatctctactaaaaatacaaaaattagccgggcatggtagcacatgcctgtaatcccagctactcaggaggctgaggcttgagaattgcttgaacccgggaggcagaggttgcactgacctgagatggcaccattgcactccaccctgggctgagactttgtctcaaaacacacacacacattttaaaatatgtttaaatgaaaaactgaggtctaggttgagggaaaaatacattattttaagaaaaagttttttagttgggggaagggctttacttgatttaaaagagagtacagaagatcagaaactcacattgcagtcccaaattggtaactttcttttttgttgattcattgaaggcatccctaaaagctcatttttatcaaattcaaaaataagaattgtagccaggtgtggctcacgtcaaaatcctacttcgggaggtggaggcaagagaatcacttgagcccaggagttcaagcccagactgggcaataagtgagaccctgtctctattaaaaacaaacaaacaaaaacaactaattgcatgctaatgccaccacttatccactcaagaaaaggcaactctacttgtaagctcgtaggctatgcataaagcaatcacaggttgttagtaaagagtacctaaaactaaggctagacagaaccattagccctccacagaggttgaatcttaaattttgtgaagataaaaattgcttcccattccaaatcaacatttattaaaaaaaaaaaaaactttaatgaaatgtagctgggtgtggtggctgacacctataatccagcactttgggagccaaggctggaggatcacttgagcctaggagttcaagaccagccttcaccatatggtgagactctgtctctatttaaaaaaaataaataaataatcctagcactttgggaggccgaggcaggtggacttgaggtcaggggttcgagaatagcctggccaacatggtgaaaccctgtctctactaaaaatacaaaaatcagctgggcatgggccaggcgtggtggctcacacctgtaatcccagcattttgggaggccgaggcagttggatcacgaggtcaggagatcaagaccattctggctaacacggtgaaaccctgtctctactaaaaatacaaaaaattagctgggcgtggtggcgggcgcttgtagtcccagctactcaggaggctgaggcaggagaatagcgtgaacccgggaagcggagcttgcagtgagctgagatcataccactgcactccagcctgggcaacagctccgtctcaaaaaaaaaaaaaattagctgggcatggtggtgggtgcctgtaatcccagctacttgggaggctgaggcaggagaaactcttgaacccaggaggcagaggttgcattgagtgaagattgcaccactgcactccagcctggacgacagagagagacttcatctcaaaaataatcataataaaagaaaaaaaattagtgaaatcagattttctatattatgccttacaaggtataaaaaaattaggagtctctaaaatataattttaaatacatattcatttattgtagatagcaaaaaaatttcagtttagctggagaacattactaatgttcactattagaaatattttttatgtattggggactaagcactgctacctactaaggatgtcattttgaagcaaatgaacagggttaccttcttcaaatttgctgttcagtggggaatgcgtctgaaactaggatgtatggtgatggctaagctgagacctaaaggtaaagtaaggagtcagaaacatgaggggcagaaaaggggtataaatttgctgaatcccacctatttcaggaaaactaacacagtgacatacagaagatacccatctaggtattcatatatgtttatgtatatagatatctttgggggggtgagtaccacagaggcacatagttctgaagcacgagctaccaaaagtttatgcttttaagtataaagcctgtagttgtctcctgctatcagtaatgggcaaagcagcagcacaaggaatattagagaacagtataaaatagtgtaaaattaaatttccagggaccacaattgccttttaaaatttggaaacataaaaataatcaatttcaactccacaatttaaaaataggaaaagagaggctgggcacggtgcctcacgcctgtaggccgtgagcactttaggaggccaaggcaggtggatcacttgtggttaggaattcgagatcagcctagccaacatggtaaaaccctgtctctactaaaaatacaaaagttaaggccgggtgcagtggctcacgcttgtaatcccagcattttgggaggctgaggcgggcagatcatgaggtcaggagttcgagaccagcctggccaacacagtgaaaccccgtctctactaaaaatacaaaaattagctgatcatgggggcaggcgcctgtaatccgaactactcgggaggctgaggcaggagaatcgcttgaacctgggaggcggaggttgcagtgagcggagatcgtgccactgcactccagcctgggcaacagagctagactccgtctcaaaaaaaaaaaaaaaattaacttggcgtggtggcacatgcctattatcccaggtactcaggaggctaagggaggagaatcacttgaacctgggaggcggaggttgcagtgagccgagattgtgccatggcactccagcctgggtgacagagtgagactctgtctcaaaaaagtaaaaaaataaaaataggaaaagacaatgactcaagatcatatagcaagctagtaacatttattgagtactttctatgtgtcaagacactgttcttttttttttttttttttttttgagatggagtttcgctcttgttgcccaggctggagtgcaatggcatgatctctgctcaccacaagctttgcctcccgggttcaagcaatcctcctgcctcatcctcccaagtagctgggattacaagcacccatcaccatgcccagctaatttttgtatttttagtagagacggcgtttctccatgttggtcaggctggtctcaaactcccgacctcaggtgatctgcctgccttggcctcccaaagtgctgggattacaggtgtaagccactgcgcccagcccagacactgttctaagagtgttacaggtgtagtctcatcaatgcccagagaaggtactgatgttatttccatttacagatgaaaaaaactgaggcagagcagttaattaacttaatgtcatttagagtgtaagttgcaaaaccaagattctaacacaggcactgtgcctccaaagccccatgccgttaataaccacaatatattaaacttctcttgaaacaaaatacaaaactcagtgcattttccactatgtcatttcatctcccttcctcaaacagtactttaaaagacaggatataaatagcataactcagcaataactatcaatattactgatgcataaccttttgacctagcagttctacttctagaaatgtatatggtacagatgtactcattcacattctaaatgtgtattcaaggatattctttagtgttgttaataatagcaaaggattggaaataagtatctatcaaaaggtatgtccagtggaatacagccataaaaaggaatgaggcactgatgcatgctacaacatgaatgaaccttgaaaacattatgctaagtaaaagaagccagacacaaaagcgatatattatagattctgttcatatggaaatgaaaaataggaaattccacagaaacagaaaaatgattagtggttaccaggggctagagagaagggggaatgaggactgactgctaatgagtacagggtttctttttggggtgatgaaaatattctggaattagtggtggtaattccacaactttgtggatatatttaaaatcattgaactatgtactgtatttatttatttatttatttatttatttgagatgagtctcactctgtcacccagactggaatgcagtggtgccatcttggctcactgcaacctctgcctcctgggttcaagtgattctcctgcctcagcttcacgagtagctgggattacaggcacctgccatcacacccagctaatttttgcatttttagtagagatgaggtttcgccatgttggccaggctagtcttgaactcctgacctcacgtgatccacccacctcggcctccccaagtgctgggattacatgcgtgaaccaccacatccggctgaactatatactttaaaaagatgaattttataatatgtgaattatatctcaaggtggtggggaggactaggcattccttgaggtcagagactccaagcagcagaaactctctcctgttgctgggtttgaacaaacaagctgccatgagttttatagctgccaacaacttgaaggaatttgggagcgaacccttttgtagttgagtctccaggtgagaatgcagcccagctgcatgattctagccttgtgagactctgagcacagaccccagctaagccatgcctggacttctgacctgcagaaactgtgagctaatacagtattgttctaagccaccaggtttgtgttagttgttatgcagtaatagaaaactaatacagaggtcacaatatgcctggcattttctttttctttctttctttttttttcttttttttttttttttttttgagaggggtcttgctctgtcacccaggctggagtgcaatgacacaatctcggctcactacaacctccacctcccaggttcaagcaattcttctgccttgggctcccgagtaggtgggattacaggcacacgccaccaggcccagctaatttttgtatttttagtagagacggggtttcaccatgatggccaggctggtcttgaactcctgacatcaggtgatctgcctgcctcggcctcccaaagtgctgggattacaggcgtgcaccactgcgcccagccatgcctggcattttctaagtgcttgcctggcattttctaagtgctgtgtgtgtgtgtgtgtgtgtgtgtgtgtgtgtgtgtgtgtgtttttgagacggaatctcgctctgtcgcccaggctggagtgcagcagcgcgatctcacctcactgcaacctcttgcctcccaggctcaagcgattctgctgcctgcctcaacctcccaagtagctgggactacaggcgcgatgccatcacacccggctatttttttgtgtttttagtagagatggggtttcaccatgttagccaggatggtctcgatctcctgacctcgtgatctgcctacctcggcctcccaaagtgctgggattacaggtgtgagtcaccgcgcccggccagtgctttgtatattttaactcatttgattttcacaacaacgctatgaggtaagtactcacattattcccatttttctaataaagaagctcattaggtgctaagtgtttaaaaaaaaaactggctgggtgcagtggctcacatctgtaatcccagcactttgggaggccaaaggcaggtggatcacaaggtcaggagttcaagaccagcctcgccaacatagtgaaaccccatctctactaaaaatacaaaaattagccaggcatggtggtgcacgcctgtaatcccagctactcgggaggctgaggcaggagaattgcttgaacccaggaggcagagatggcagtgagccaagatcacaccactacacgccagcctgggtgacagagaaagactccatctcaaaaaaaaaaaaaaacaaaaaaaaaaacgaaaaacaaaaaacaaggcgcagaacaggatgaatagagggttagtatttatatcaaaaaatgggaaatacagtgaaatatatacaaatatttacatctatttgcataaaactttactggaagtctacataagtagctagcaatattgattgcctatggaaagggaacaggggctagaagatagagatgggagagacttttccctctatgtcctttcatacttttcatgtaaaagacaggttaaaaaaaaatatatatatatatatattcttttttttttttttgagacagggtctccctctgtcatgtcatggctcacccagccttgacctcgtgggctccaatgatcctcctgccacagcctccgagtagctgggactacaggtgtgtaccaccatacctggctaattttcttattttttgtagatattggggtcttactgtgttgcccagactggtctcaaactcctaggctcaagcaatcctcctgcctcagcatcccaaagtgctaggattataggcataagccaccatgcttggccaaaagatgtgatttttgatgctcacatatatcttgagccttgtaggtcacacagctaggaggctttttgttttttaacattttcatttaaagacagtagtaaagataataaagtccagtcaacaaaaaagtaccactaacatctaattcatagaactttaaggatcttaattagtttgattcattttatggatgaagaaaatattacaaggttacaactccactgtccattcagatgcattaaaaaatgtgaaattgtcattccctccatatattgagcaacaataattctacttccaaggagtcatcctctttccccaaagggtttttctggttactcattgagcaaatatttcttaggtgtgtcctagtgagaggtgacagcgtgctagcagtcctcacagccctcactggctctgggcgcctcctctgcctgggctcccaatttggcggcacttgaggagtccttcagcccaccgctgcactgtgggagcccctttctgggctggccaaggccagagccagctccctcagcttgcagggaggtgtggagggagagccgcaagcgggaacccgggctgcccgcggcgcttgctggccagctggagttccgtgtgggcgcgggcttggcggccccacactcggagcagccggccggccctgccggccccgggcaatgaggggcttagcacccgggccagtggctgcggagggtgtagtgggtcccccagcagtgccagcccaccggcgatgcgctcgatttctcacccggccttagctgccttcccacggggcaggactcaggacctgcagcccgccatgcctgagcctcccaccccctccatgggctcctgtgctgacccgagcctccccgatgagcgccgccccctgctccacggcgcccagttccatcgaccacccaagggctgaggagtgcgggcgcaaggggcgggactggcaggcagctccacctgcagccccagtgcgggatccactgggtgaagccagctgggctcctgagtctggtggggacgtggagaacctttatgtctagctcagggattgtaaatacaccaatcggcactctgtatctagctcaaggtttgtaaacacaccaatcagcaccctgtgtctagctcagggtttgtgaatgcaccaatcgacactctgtatttagctactctggtggggccttggagaacctttgtgtccacactctgtatctagctaatctagtggggacgtggaggacctctgtgtctagctcagggattgtaaacgcaccagtcagcgccctgtcaaaacagaccacttggctctaccaatcagcaggatgtgggtggggccagataagagaataaaagcaggctgccctagccagcagtggcaacctactcgggtccccttccacactgtggaagctttgttctttcgctctgcaataaatcttgctactgctcactctttgggtccacactgcttttatgagctgtaacactcactgcgaaggtctgcagcttcactcctgagccagcgagaccatgaacccaccagaaggaaaaaactccgaacacagccgaacatcagaaggaacaaactccagacgtgccacctcaagagatgtaacactcaccgcaagggtccgcggcttcattcttgaagtcagtgagaccaagaacccaccaattccggacacactagggaagcctgaaaaagaccctcttaatttggcaagaaaccatgttgaagttgattcctggttaatgactggaagaaaaacttccatgcaatgaggagaagcaacaaaagggagaaattcaattgaaaaaaagaatatagttagcaatgaacaagaagcaagtgtcctctcaccaacacagctgactctggtaaccacaaacctcagctaaacccagaagtcaagagctgtcacttaagttttgtttcatttctgagtgaaacccttctaagactttattacatgcaatgccatggattaatgtcatagacataatgttaaatgaaagacgtactgtatgatcccatttacatgatgttcaaggacagacaaaaataatctatggtaataaaagaattgtggttcccttgtgggggtgaagatgtactgtatgatcccatttacatgacgttcaaggacagacaaaaataatctatggtagtaaaggaattgtggttccctttttggagtgggggtggtaggtaattgactcaaaggggacatgaaggaactttctggaatgatggaaatgctctgtatcttgatctgggtggtagttatacagacaggggcatacacatataagtattcattgaactgtatgcatagagttgcattttattctgtgatgttattcttcaattaaataaacaaaaacaaaacttttctatggattctcattattccagggacaaagataagaattcttcatgtgggcaatggacccttactgattctgacctttgcctgcctttccatcttgcacttcacttccctaagctcctccttggttcttcctatgtctggcacacttgccaaactccctggccatgcaatcaacctcagcacatgatatgtttcctgtgtgggatgttattcttccccgtgccaccctcttctccagttccagtaagctactgcacttcctttggctgaagcttcacttccctgtgtgaacttctttcataatcggccccccattctaggtcgagttccccattggatgctcttacagaattttgctccttttactcagaccatttacctcccaatttcctcaatttgtaattactccctcatttgtgggactatttaattaaatctgtctctctcactacagtctgtgccataccatggactgagggtcaatgtctgggttctgcttaccatggtatccccagggctcaccacagtgcctggaacacagtaagtgtttactaaatatgtttttgggccgggcgcagtggctcacgcctgtaatcccagcactttgggaggccaaggcaggtggatcacgaggtcagaagatcaagaccctcctggctaacagggtgaaaccccatctctactaaaaatacaaaaaaaaaaaaaaaaacttagccaggcgtggtggcgggcacctgtagtcccagatacttgggaggctgaagcaggagaatggcgtgaacctaggaggtggagcttgcagtgagctgaggtcacgccactgcactccagcctgggcgacagagctagacttaaataaataaataaatatgtttttgactcctgaggataaagtgactatctgatattctctggcagaaaaattgttgatgtctcacattacgtgatttggatttatccccattaaatgtttggtatatcttgctttaagcaaactgaatccattatatggaaatctgtatttattcaaaatataaattagagtgcatgtactcaaatgcctgttacgagatttatacaagttccaggtgttttttactgcatttgaaaaatagatgagcttcatttgccaaattcaagcctagttgaaatcaatagggtttaagaattggaagtgatggttttcttctatcagctgactggccagtatagacgcagttatagagtcatttacaccactgccattatcatctgaacaaagatctaaatttatactaacttcacgttgtggttggtggagctctgtaagtaagaaggaggctggtgccaacaatccaagttacacaaagagaaaaaaaatgctcaagaggaagtggtacactacaaaagtgcaaacgtaggtggaatgtgtgaaaaaaaaaattttcaaattaaaagtgtcttcgattttatgtttttatgataaaagaggccaaaagaaagttgtctggaacttcctattttcaagataacccatctcagcactcaatttggaagacagtgaataagttggaggaaaagaagtaacaatacagagagaacatgtgaataacaccttgcaatttaccaaatgcttcacttattctctcaacctgctaccaggccctaagatgggcttctgaggttacagctgtaaacaagcagatccatcctgaccctgtttgttttctgatgcttctatacccattgcctcatttaatcttcccagcattgtcagagaaacattgttacatttgtcagatgaggaaatggtaacttaactgccttgctcaaggaaacatcaccagtaagtgagggaacaggactcagatttgcctcctaaatctaattgcaaacccttgcaactaccccagttctacttgcttataggcctctgggatggctactttgttaatcaagactctcaatggaaatcaagaaaaattacaaagttacccactgggcattttaatcattcctctatgtatcatttctctcccttgttttgtcctttcatttttctgagtgaacaggaatattcccaccaactcccttaaaaacacaagtttcttcactaatttctcgtagctcctacagatttatatatgatttctgggcagacagaagtaatcaaagtcatccaatttctttggctgaccaataactaaattgagagctgcttcccttttaagtcacatgattcaggttattgttttattatttggtgcttcatagtaccagaaaggtattcagacttaattttggacattttctccccagtccataaaagcctggtaataaaaagatatttgacatgaccttttgctatatggttggtgctacaaaatgctgattttaagagaaattagcaaaagtacatcaacatatgaagagatgaacaagatatcttacatttatacaatggaatattatttgtccataaaaaggagtgaagaactgatacatcctgcaacatggatgaacctggaaaatactgtgctaagaaaaagaagccagtcacaaaatgctgcatatggtatgattctgtttataggaaatgtccagaacagggaaatcaatacagacagaaattagatcagtggtttcctagggctaggttaatgagggaatttggggatgatagctaaagggtacaggttctttttaaggtgatgaaaatgtagttgcataattctgtgattatcttaaagacgattgaattgtatgctttaagtcagtgaattgtatggtgcatgaattatatcaatgaaacttttttttttcatgtctgacgggtaatgtgctgaaatttatgaactaccaaaggatctaaaaccggttttttattattttttatttttatttatttatttaatttttttgagacggagtcttgctctgtagcccaggctggcatgatcacagctcactgcaaacttgaactcctagcctcaagtgatcctcccacctcggccacccaaagtgctggaattacttacaggcgtgaacccccacacccagccttaaactgttttttaaaaaaggaggttgatatagtgttccactaatagcttgggggaaattctttctcaggtatataatacaggaagttatttgacaggcaactatgcttaaatttatgttaattgtgtagaaagaactgagtaaatcatttcctgttttctctccacctgcccccaccaaaaaaagaaaagaaaaaattctaaatttgaccaatacaataatagcaagataacgcaaagattacaatgggatatggcctgggtcaattaaagcaccagcaattggcattggaccctccaccttatgcatgtctatatccagccatgatgtgaatatgtgagtagcaaaagtgctagctgtgtcttttcctgatttttttttttttttttttttttttgagatggagtttcactcttgttgcccaggctggagtgcaatggcgccatctcagctcactgcaacctccacttcccaggttcaagtgattctcctgcctcagcccccagagtagctaggattacaggcatgcgctaccacgcctggctaattttgtatttttagtagagacagggtttctccatgttggtcaggctggtctcgaactcccaacctcaggtgatccacccgcctcggcctcccaaagtgctgggattccaggcgtgagttaccgtgcctggctcttttcctggtttttatattttaatgattcgtattagagttaattcacattaaccctcttcaaaaagaacattaaacctaaagcccagtgacttaacaacattaaatattccagattcttttccccaaaaagttccatttcaactcttggaaacaaaaagttagataatggtttggctttaaatgcctcatttcaaatgtccttccccataatactcccaagtgaaaaaaatattttttcccaattattttttcatttaatgtaaaacattccagttaaaagagattctcaaaaatagagctttacaaaaaatacgagttcaagtttcagtaccctacccttcccccacccccggcccagtggctctgaaaagataggcaattaataataagttttttcctaagaaatctttggggaaccagccaagtttaaatagggtaattggtaggtctatggttgcaatttacataaattatagaaacataacaccagacatttatctaattgaagaaaatgtggtgttcagttacttatctagaggaattctacttgcagtttgtgccatttggtgattagtccattctcttgagaatctgagttgctctagagacagaatatatgataataatggtccaaaaaatcagttttgcttacttagcaacaacaaaaaatatatattaaaaataaaatactattcatatacatttccttgataaaaatagtattgaaatagtataaatccataattcctttagaagatgcttatccacattcctgttagagatgtggagtagttaacactcaccagatgatgctctccttccttccttccttccttcctttctttctctttcttttttttttttttttttgagatggagttttactcttgtcgcccaggctggagtgcaatggcatgatctcggctcactgcaacctctgcctcttgggttcaagtgattctcctgcctcagcctcccgagtctgggactacaggtgtgcgccaccacaccctgctgatttttgtagttttagtagagacggggtttcactatgttggccaggctggtctcgaactcctgacatcaggtgatccacctgcctcagcctcccaaagtgctgggattacaggtgtgagccaccgcacccgccaatgctctcctttctttcagtgctaaagaactcttcactctcttaatcaatctgttattacaagtcctatggccctttgttgaatttctgtttactagaaatataataagcaacgtaagatatttaattttgtcaaagtcgttccaaatctcttatactaaataagtataaagatactatatatgtatatatatatgtgtatatatgtgtgtgtgtgtatgtgtgtgtgtgtgtgtgtgtgtgtgtgtgtgtatatatatatatatatatatttttttttttttttttttccacccaggctggagtgcagtggtgagatcacagctcactgcagccttgacatctctggctcaggtgatcctcccacctcagcctcccaagtagctgggaccacaggcatgcaccaccacccgggctaatttgtattttttgtagagatgggattgtgcaatattgcccaggttggtctggaactcctgggttcaagtgatctgcctaccttggcctcccaaagtgctgggattccaggtgtgagccaccatgcccagcctgataataagcaaaattccacttccctagtgctacagactaaatttttatgtcccacccaaattcatatgttgaaactcttaggatttcaccatccttgataattgtcagataaagaagtaggacctttgggaggtaactaggtcatgagggtggagccctcatgcatgggattagcgtctttataaaacagacttcagagagcccctttacccctttagccatgtgaggacgcagtggaaagatggctgtccacgaatgagggagtggttcctcaccagacactggatctgccagtgccttgatgtcaaacttcccaccctctagaactgtgagaaataagtgtttgttgtttataagccaccagcaatatggtactctgttacagcagcccaaactgactaagacatctatttcttacctgaaggagtttgaagtggggtcaaatgcaagttttacattcttttaaatgtaaaagcctgggcgcagaggctcatgcctgtaatcccagcattttgggaggctgaggcaggcggccatcacgaggtcaggagttcgagaccagcctgaccaacatggtgaaatccctgtctctactaaaaatacaaaaattagccggaagtggtggtgtgtgcctgtaatcccagctacctaggaggctgaggcagaagaattggttgaacctgggaggcggaggttgcagtgaaccgagatcacgccactgcactccagcctgggcaacagagtgagactccgtctcaattaaaaaaaaaaaaaagacaaaatagcatacaattctgtctcaaagcctcaagtacctttaactacagtctgtctacaataacctaagacattcaaaagacaggagaatgctcataccctcatgctgggacactgataatctggagcttactacattgacatcactggcacccacttactaaacacatgcaattacttagcaattagttcttgaacaatttgtgtttgctaagaactatatctgacccagggaataaaacataagacacagttcctgcttgtaaatacactagcaaaagagaagaagactatcttgtagagactagctgagtcagtgaatgtcagagatgaagaggaagggcaatggcatgagtggaattccaggtagagaaacggtgagagaaaaaaagaacaaagataccaatgtgagaaacaaaaaggtttctgcagcagggaagcacagttggctgttgtggtatacaggatgaggcggcaagtggagaggcgggctggtctgaaggctctagctgaatcacagaacatatgccacattaagggatttggatttaatcctgatgcaaaatataagaagttaaggattttaggtagaagctgacccaatcagtcgtgcattttagacagatcattctgggtttctttgttgtttttaacttttcatttctttctctctttccttttttctttctcttcctgtcctttctttctccttccttccttctccttccttccttcattccttctccttccttccttccttccttctttcttcctttctttcttagggtctcactcggtcacccaggctggagtgcagtggcacaatcacagatcactgcagccgaaacttccagggcccaagctatcctcctacctcagctccccgagtagctgggaccacaggtgtgtgccaccacacccagctaattttcttattttttgcagagacgggagtctacctgtgttatcaggctggtttcgaacccctgggctcaagcagtcctcccaccttggcaacccaaagtgcttgattacaggtgtgagcattctggttctcgttatagaaggtggattttaggtggattggagtcaacaaaactacttaggacattgttgcaaaaatctaggtaaggatggcttagaacttctccatccttggtcattgtcagcctagatacaaactgaggttgcactacagtgtgagagaatttcaaagaagcaggaaagaagtagagatgggttttactaaagtactagtaatcacagttactaaaggatgctgttgtttttcccccactccccaccacattctttttttaacatgtcagtaatttataactttctgaaaggaccaaataataaaccataaaatgatgatgccaggtgttttgttacgtgtttttgttgttgttgttgttgttgttttgagatggagtctcactctgttgccaggctgaagtgcagtggctcgatcttggctcactgaacctccgcttgccaggttcaagcgattctcctgcctcaacctcccaagtagctgggattacaggcacgcgccaccatgcccagctaatttttttgtatttttagtagagatggggtttcaccatgttgaccagaatggcctcaatctcctgacctcgtgatccgcccgccttggcctcccaagtgctgggattacaggcatgagccaccatgccaaggtgttttaattgtttttggtgttttgttttgttttgttgttttgttttgtttttgagactctgtctctcaggctggagtgtagtggcaagatctaggctcactgaaacctctggcccctgggcttaagcaaccctcccacctcagcctcccaggtagctggaactatgcaggtgagtaccactgcacccagctaatttttgtattttctgtagagatggggtttcactctgtggcccaggctgatcttgaactcctgagctcaagcaattcacccagcttggcctcccaaagtgctagaattacaggtgttttaaaataagccaaataaaggatataaacacttccaattcataattcagatgtagaggaccttacaatagttaacaattttcaagctaaaaatcacatcatctataaaacattataagtgttttccttattgaaatggtttagcggaaggccgtagggcttgaaatggagtgacggaacacaaacatgtaagaacagataagaagagtggatggttagtttaggaaggttttccctttccattccaagactagattctggcaatatctggtatgtcaaactaagatatgtaacatttaaatacacaatattatttttattgtgaaaatagtttaaatatgtttagaatataaaatttgggctgggcatggtggctcacacctgtaatcccaggacttgggaggctgaggcgggcggatcacctgaggtcaggagttcaagaccagcctggccaacatggtgaaaccttgtctccactgaaaatacaaaaatatagccaggcatcatgtgcgtgcctgtaatcccttgaacccgggaggcggaggttgtagtgagctgagatcttgccactgcactccacactgggcaacaaagtgatattccatctcaaaaaaaaaaaaattgtgccagacgcttgcagaacgcctgagacacctccatgaaattctaacaatgcatactaaatgctttataatccttctgttgaaaaccagacattcaagagcatacagcttaattccagcagagggcagcaaaacttcactaagcagttttcaaaaccctagcagcttttctgtattacctaataatatttttaaaatattcccccagaagagttctgtagttccacaactacaatctcatagtatttgtggaattacagtattaccatacttatatttaggcaggacagaattcttcccagagttcaaagactgcggaaggctcttagatggataggacctggggcaatgccaagagggaataaagacgagccacaatgtcttactggggtcatctgcctggtggttttccaactcttttacaaagagtcatgatttaaggtacaatgggattcttttaaaaaatatgttgtcactgcaggtatggtggcccatgcctgtagtcccaggcactggggaggctgaggtgggaggatcacctaagcccaggagttaagagtcctgcctgggcaacatagtgaggctgcatctataaaagcacgcatatatatgtatatgtgtgtgtgtgtgtgtgtgtgcatatatatgcacacacacacacaaaatatatatacacacacacatactcacatattttatagttgtttatataagcatgtgtatatatatttataataacagttacaacatatatatgttgtaactatgggtctgagttttctcatctgtaaaactgagataataattgcaccagcagggcgcagaggctcacacctgtaatcctggcactttgggaggctgaggtgggtggatcacgaggtcaggagttcgagaccagcctggccaatatggtgaacccccatctctactaaaaaataaaaaaaattagctgggcggggtggcaggcacctgtagtcccagctactcgggaggctgaggcaggagaattgctggaaccagtgaggtggaggttgcagtgagcagagatcgccgcactgtactccagcctgggcaacagagcaagactccatgttgagaaaaaaaatggcacctaggccagccacctgcagtggctcacacctgcaatcttggcgctttgggaggccaaagggggagaatcctttgaggtcaggagttgaagaccaacctgggcaacaaagcaagaccccacctctacaaaaaaattaaaaactagctgggcatggaggtgcatgcctgtagttctagctactcgggaggctgaggcaggaggattgcttgagcccaggagttcaaggctagagtgagctatgatcacgtcactgtaccacacactgtataatagggcaagacagtgtctcaaaacaaaataataatgattgcacctacatcttaagaggttgttgcacagattaagcgtaatgtaaaatgactggaacactgttaggtgtggtttttgttgttgttgttgttgttttgtttttttgtttttgtttttttttgagatggagtctcgctctgtcgcctaggctggagtgcagtggtgtgatctcggctcactgcaagctccgccttctcggttcatgccattctcctgcctcagcctcccgagtagctgggactacaggcacccgccaccacacctggctaattttttgtatttttagtagagatggggtttcatcgtgttagccaggatgttctcgatctcctgacctcgtgatccgcccacctcggcctcccaaagtgctgggattacagctgtgagccaccgcgcccagtcactgttagctgttttttaaaaaaattgtaaaatacatataacagaaaatttaccatctcaaccttttttttttttttttttttttttttttcagatggagtctcactctgtcgcccaggctcctaggctggagtgcagtggtgcagtctaggctcactgcaacctctgcctcccgggttcaagtgattctctggctggctaatttttgtattttttacagaggcatgttcaccatgttggccaggctggtctcaaactcctgagctcaggtgatatgtccaccttggcctcccaaagtgctggaattacaggcgtgaggcactgcacctggcctcaaccattttaagtgtacagtctacataagcagaatatatatgggagaaaaaagcatacagtccaatagtgttaagcatattcacactgttgtacaaataatctcctatccccttttcatattgcaaaactgaaactctataccaattaaagaacagctcgccatttccctctccccgcagtacttgctaaccatcactctacttcctgtctttataaatttgactactctaagtacctcatagaaatggaatcatatagtatttgtctttttgtgattggcttgtttcacttagcataacatcctcaaggttcatctatgttttatcatatgtcaggatttctttttaaggccgaataatattccattgtatgtacacagagctgttacattttaaaacagaaatttaaaaaatgactttgagactcctgcttccaattatactgatccccccataaacaactagaaaactggccaaaatactctaaacaactatattcagaaatcagacaataggcagtgtggattgtaatccctaaaagaaaggaaacaaaaaggtaaaccctaaaaccacaccggaattttgtctgaaggcaatttccaggttgtggatgcggggaggggaatgcaagtgaagctgagcaatctctccgagatttggggagcagaaggtaactgaaagttgccaggcaaaattctagagaattggaagctttgtagaaaaagagtttcagaagaccgcataggaagtccccttgactatgcatgtgtggagtaaaaccttcatgaggctgagaaaataaagacttggaattgtaaactgaattacactcagtgttcaaactgagtggggagaagtgagaacttcaattagccaaggtcctgaataaccaatggaaagtcttcaataattaactgagccatgtgacaaatattcagggggatcatgcttagacggaataatcctggagtaaaggctaatctatatctgccatagcaaaaattaaaataggccttaaaagtatcaaactgggctgggtgtggtggctcacgcctgtaatcccagcactttgggaggccgaggcaggcggattacctgaggttaggagttcaagaccagcctgaccaacatggtgaaaccctgtctctactaaaaatacaaaaattagctgggtgtagtggcacatgccagtaatcccagttattcgggaggctgaggcaggagaattgcttgagcccgggagacagaagttgcagtgagccaagatcgtgccactgcactccagcctggctgacagagtgagactctgcctcaaaaaaaaaaaaaaaaaaaaaagaaggtatcaaaataatctataattagcttacctgcctgccataacaaagcctgatcttctcttcctctcttctcttctcttcctttgtttccagctatgattgcaccactggagtatggtggtgcaatcatggcccactgcagcctcgacctcctgtgctcaagtgatcctcctggcctcccaaagtgctgggattataggcataaaccaccacggctggactaatattcttcttcttttttat

SEQ ID NO: 200 - DNA, 2704 bp, Homo sapiens
taatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtat

SEQ ID NO: 201 - DNA, 103525 bp, Homo sapiens
ggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgacgagaagacaactaaaacatccacactaaattattagtgttttgacattacctaaaccctaattatgtaatcagatgaattatttaaattatgtagtaaaattactatttaatattattaaatattgagttgatactacttatttagttaaagtatttatattattattgaattaattaaattggttccaaaatgtctttgacacatatataaaacatacgtgtaacacagaaaatggctttttaatcagatatcaataatttatagggactaccaatatgaaatataagctgattgagctggctttatttgtgttaattacatatgacacggtctattttctaatacttgtgacccattatttgtacaaatccagggaatatacaagactttcaaagatatatatcaaagcacatgatctcaaatactatattttctaattagacaaaataatttcacttggtagacaagatcctattagtatatttcatatcacattgctgttattaatctattttgtatttaaaattctgaaaatcattacacttagactgattcatttacctagagagtccattcaaaaaaattcatgaaaacaaacaataagcacttcaacaaatatgcaatgactcttctgtgaatcccaaaatattatgaataacttttgtcattgtaatttcttgtacctcagaactgtattttccctttacttcttttttaccatccctcaaaatattttctatagtcaccaaattttagaagacaatagcagtaaaaggaaaataaaagccttttgaaatgcatgcttaagtaggacatttcccaaatcacctttttaaagacaattcactatgaaacccttaaggtctataaagcccatgtgattttattcgctaggcagatctaagagttgagagacagttgacactttttaaatatgcgttttattaaattacttgtgaccacaagcattaaaccaaatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataataataatacatgtaccccctgaatctaagagtttgttacatggctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggcctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatctcttactgaagctcatgaaaaagaagcagcgtggctttgtataaagttaatccacctctacagaaaggaaaaataaattctgcccctacaaaaagttctttggaacacttaatccttagattgatacaaattatttagttttgaaggaataagaactatattaacccaatttcacatattctaagctcctaattgatgaccctaaatatttttgaatcaatcaagctaatatgactaactaaaataaatatcattttcttcctcagtcatagattgaagtctgagttagatgagaacatgaaaggagctgtggtgtcagaactgcaattatattcgcagggtcattcagactttacaagagcttacagccattgataactttaaaaagtgtttctactttgaagaaatgcggtgagaaatggagtcaatatttttagaacttaacattgagttttgttttccattttaattgttactcttttgcttgatttccaaacattattatgttgcaagaacagtataaaaatccatgccataaattccattaaagtctaacatgagtcacaaaaatgtatcaaaactcattatgagtgaatgacattaccttgattatctatgattgtaaaacttgaattgttagtgtcttctacagatagattaaagtaaaaatggtgctcttctatggattcatctctatccactgcactgatagtctgaattacctaaaaaaaaagggggatagatttttgttgttgtttggattcaggaagaagatcactgctgctattattattagcttttattcacattgctttattacaatcaatagggacattgcagaaaataactgtcaaatcagtggagaatattaaaatgttttttctcaggttaaaaatatgttcacttccttttttcaaagagtgttgtaatattacataataaacaaactcttgttgatggatcaggtggattccaaaagctgtttgttgaaagtctccaaagcattgcttttgtattactcacatcctccctgcctacatttcactctttcttccttcttaactttttctttatctgaatgtcagacattatgatttgctaaagttgtctatttcctgtttttactgagagcaaaactgtggtagagttactggcttactaaactatttgctgaagtaatgagatttgcaattgattgaggaaataatgcatttaaaatgtaggggcaatgtacatgatttcctttgacccataatgattataggaaagtgttttacatcaaataagttcatctctatatctcagatcataaaacaatgaagtactgcagacatgaacaaatccattttcaattaattttcttctttcaagacatgaatctgtcagtcaagtagttcattattgtcgaaaaagatatgctgtcaagatcacatagtgagattgtgattaattgtggaaattaaagtaaattgattatagaagttattgtttcgaattttctacaattaaagtgcctttaacaatatgtcaaacaaaaatagcctcagatgcaagatgacaagcccagatttatattatacttcaaaaaaatagatacatcttcacaggcataaagaacattaggaaaccaatacgatctgtatattacttctccacattgatttatttttaactcattacacattactaataaataatattcatttagtgttaattaagtaatttaacaaaacacattttattcaatccatgcttataattatacatgtggatattgatttatgttaaggtaaagccttcattttagaatattacaggattttgtataggctgggtagagggcaggggcttggaaacccaatattctgaatcctggctttgccatttagaagtttttaaccttgaaaaataaaaatactaatacttaaccttcagggttcattttcaggattataggtcttggcttgtcagagggtttgtcacacgacaaactattatgtgttcctatgtctattatgtgttcctcatgaaaatattctcttgttgagtttttgcatatcatggtgtcctgaatattgttagtcataggcatatggatatctttatatgcacatttgctgaaataagattgataacaaagtatagaattcatgtttatcttgctggcatatgtggctacagtgttcagataaggaatattttattttactacctgatgttctgtattaaacatgagcatctgagtaaatgttgcaaatgtctccctttgggaatgaagacttaagaagactggagatatgctgtatgtatgtcaaaagatttttaataaatcaaaataccttatgcatatgtacaggaaactgaatgagcaagatttcaacagtctgcctccttttaaatgatcatgtctccacttatatttgctttgtaagttgggcttccaataagatatgttttactggctttcataattactttataaaaataggaagacacagacataaaatgagtcatatatcaagtattatgaattttattgaagttaccttgaacaggtacacttaaacacataccactaataaagggaccacattaatatgctaataagttttgatggaggatatttatttttcctttaaatataccaatggaaaggttttcattttcattttaaaataaaattataagaaaaacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacgtagaatgttggccaatttatttctgatgcagtacattcaatcatctatatacagtgcattgaaagctacaatggaaatacattgtgtaagccccaagaattgaaaagtaactacaatttaataagaacttacctatgggccaggatctgttctatacattatcttagataatcttcacaatggtctctggaataaatcctattattgttcccatgttataaatgtttatattaagcttcatataagctaagtgtcttaggtaagtaaattggctgggccagaattagaatgtaagctgatgtcataggcaatgtgaaatatgagtagtaagtgtagccctctaggacatattgttcatatcctagacttgttcttgtcctaccagatttacatacaaaatgataccgtaaaagacatgaaattccaaaagcaagtaaaaatatgtctcataaaagttagtgacagagaaataagtaatataattttgtagaataaggaccaaaaataatggttaaaaatagaagaaaataatgtgttttgatatgggagaaagggaagattttctagggtaagagtacagccaatgagctaatactcaaataaaaatatgaattgaggaaaaaagtgtgatcccaagcaaagaatatcaagaaaattaatgaaggcaaagatatcatacattaggtataaatgtatgaaattaatattttgtagattaaagatgacctactaatggaagtttcataagttccaatttagttattttatgaaactataatcactatttgactttaaagataatcaggagaataaagataatcatttgcctgctattaatcattatgcactatgtctttttttaagaaaaagtcacacatgggccagtttactaagatatcattccagattaattatcctgagccaaaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaagatacaaatactgagtattaatttatataactcatcaattccttgaagtgcacttaataaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaaattacacctgttttgacaaaataaatctataaaactcaaaaaaggtgttgaacatctgttcaaacaggcagagtacaaaataatacactaatagaagtagaaccaacaagaaagtctaggttgtagtatgcttgttgtctttctttgtttagcaaaatattagaagaaaaatgttcaaaaggtcattatagcataatattttagacctggatagaactgaggatactctaagttttctaaaaggatttttcacaaagtttcattatatttatttaaatgtcatagatattataattgtttttgccattaacttgtagaaattgatattcagttgaaaaatacacattcctagatttttatctcaatacgtattttctaattttccttttaaagttaatattccaaatatacttttaaaattcacataaaatcagcatgtatatggaaaaatattaaactataaaatatctcattagtatcttaaatgtatccatttaaaatgtatttcattagtacttacagcactccaagcaatcctatgccctggtggtacaatcatggataaagttagtctctgtcaccactgttcacattctagtggtgaagaagatcaagcagaattgcaaacttaaaaagtattgaggaagtacagaatacccaaattacattttaaaagttataaacacctaaagtacttaatacttaaatattggggggtcagagaaccttgtatctgtgctgaaattagaagatcatacagcagaagtgagcaggggatacatcgtggacatattaaagagttttgactttatactgagggacactcccaggctctaagttgggaatgacatgatcattacttttatttgggatcacatggttccaggcaaaggactgcattttagaatgctccttctgaggacatccttagtgtaagtctggaaatagagaatctagtccgcaagctattgtcatgatcctattgaacaactgcttggtaatcaaaatcactttatgtgatatacaaaaaaacccactaacaatcacaattatggaatgtgttattttaaatgagaaacaatacagaaattactgagcagtgttcataaattgagaatggtacagtatgcttcaaatagagatataattcctgagtcccaaaatttgcctaagggtatgctgagctccagaagatgtcaccaaagtaatgttttttcaccattttcaagagggctatatattctcctcgctactctccatccagtaaaatctgattctcctgaaactgcatgactgcagtcttacctaataaatataattgatttataaaactgatacattgctgcatatgtgctgtgagattggatgaaggaaagtttgattttacaggaacatccctctgcagacctgcttaggtcaggttcactctagaagagaagataggtcccttaggttaggttcactctagaagagaatataggttcctattagggtagaaagaatgatgatagagagaaattgatacattaaagacatatgtaggagatgggatcaacagaaccaaattattgattggatatggagaataaagactagaattaattaaaaatgatgtccatatgtctttttttcttgcaaaacttgatatcataataattttcctagggatactgaagaaagggaaggcttaggagcaaatttggtgtaaccatgggacatctgagttgttttctcaggttagtcagacacatagcttaaaacagaaaaatcaggcagagatacagttatttggatatgaactgtagtcgagaggaagaagtggataaaagaagaaataatgagttcaggaaacttttggacacaaaagtgaaaggaagagaatcatagatcacaaaatgcaaccactgaaatttaggaaaaagaaaatttttacatggagacaaggtaaatgtctttagacaaaatattggtatgagtgaatctgaaaattatcgatattatactttacctccaaaaaaaaagacatttaatatcagtcaaaataatggcactcagtgatttgaaaaatgataactatttgcaccacatggcaaaggcaaattaccctgatgtcagctcatttattatattaatatttgcaaattgctgaaaattctctcctactcttccccaccctggccacttacacattaagaacaaaaccaaaaattttgtttacccacataggtatttgagtaaatgtttggattcctccagagtagagtgtgactactctggcatttttattttctatgatcaatttattatccatccaaagtagatagatataagacatccttttacctgccattttctctggctgtttgagcatgtgggaaatgagaaaagaatcatcttcataaattaaaaatatgtataaaatatttaatattctgttaatgattttaattaaaagtatgtgaagatgatattttggatatattatatcaaataaacattactaaaattaacattatctgggtgttttttatatttttaaacgtggctacaggaaaatttacaattctatcatttatttggaagcactgcattacatactcatattttcaaataatttttctttttttcagtgactttattttatatgtactttatatattgtatgaaatttggctttagaactccaacaaataatagtgtaagagaaggcattgttttcttattactgttttaaattatattaccctatcagtttcaatattacataaagttttgattatcgattgaggactataatattttatcattattatacgtattatgtgtgccttttgaagtcttatatttattacctaggatttaggtttattattcttattcattacttatttatttatttatttttgagatggagtttcactcttgtcactcaggcttgagtgcaacggtgcgatctcggctcactacaacctcttcctcccaggttcaagcgattctcctgcctcagcctcctgagtagctgggattacaggtgcccaccaccgtgcccagctaatttttgtagtttcagtagagatggtgtttcaccatgttggccaggctggtctcgaacttctgacctcaggtgatcctctcgcctaggcctcccaaagtgctgggattacacacgtgagccactgtgtcccacctaggtttacttttatctgagggtttcttagcatcaaatgaaaagttcgtgtatataatttttatgtgtattatttagttcctttgacttgatatgtaaaatatttacagatttcaaagtattgtatattgttaactttttattatttttaggaaagtttaaataacatgaaaattaactgtaactttgaaactcaacgatacaaatctcttgaccgaaaatattccttagaaacttctctgtgacatagtctcagtattattaagcataattgttttaatcctcttttctatttttcttacattatttcattttatttcattccagtctaatgactttttttaaaaacctgcattttgaaatgattatagattcacaagaaaatgtaaaccctgtgcatgcagtctctcagacacttcattcagctaaaccaatggttacatcttatgtacctgtagtacattattaatatcacacacgtatgatgacaaaacaaaaaaatcaacctctataacacatttatagtggagttcttaacttttgttttttactttgttaattcgactcccctaaacatctgatgaacgacattattaacctgctccactctcatctccaacagacattgacaatgttgtttgtgtgcaatgtcaagtgtacatagacaccgtgtagctaattcaaatctctttagaagacaatgaactccatgttaagaacttataatgtatgacatgacccttaattgtcactgttaatattaacaaaactacttttaccacagtcctcttttaccttctttcttatttgttttttatctttacaaaatccttagaagatagagattgtagaggagaagctgtattattatttttgaaatgaggagattagtattcagcatggttaggatattatcatctaattggggtagtgtggatgagtgatagagatcttcagctattgcactgtgtaatctttttgttattgtagcttgttgtttttgatgtttcattctcacataaggggaaacatatttgaattacatctcatggtttcctatacatgtgatttttagacaataatcaagaataccaatcagaaattccaggaacttaacactagaaaacaaatgtttattgcaatcctctctaaagaaccactttgcctttcaaaaacatgggacaaaacaaaacctaacaaagaaacaaaaaacaaaagacatttaaataatacataaaaagaacaacacttattttgctatcctgctcatttttctcaaagggtaaaagaggcaaatccatcaaattcaaaaagatgcactcagctatcattggaaagctgtgtgctatgtattgcttaagagtaaatgagggccaggtgtgatggctcacacctgtaatcccagcactttgggaggccgaggcaggcggatcacgaggtcaggagatggagaccatcctggctaacatggtgaaaccccatctctgctaaaactataaaaaattagccgggtgtggtggcatgcacctgtagtcccagctactcgggaggctgaggcaggagaatcgcttgaactcgggaggcagaggttgcagtgagccgagattgcactactgcactccagcctgggtgacacagccagactctgtctcaaacaaaaaacaaacaaacaaacaaaaaagtgagaaacgtgatagacagttccaatcgaaagagaaatagagcagcctcagttattaaacgcctatcttttttaaactctggccatcctggggccaagaatgataactagctggaagaaaatagctgtttttttttttttttttcagttttctgatgctgtagcacatctaagcaatctctaaaatatacaaataaatccatcatgaaaaagttaccaattatttttggagataaggaatttttttcaaaagagtaaagaaaatattgtataattttttctttttttgagttaatttgagttattgtataactgaaaagaacaaagaaaatattgtaaagcataattttaagatctgtatatcttcactgaaacacatttggagaattttatattgttttaaaattttatattttacccattctacctattaatagatttgcattataaaaaaagtgaaccagcaaatttcatggacaaccttataatcacatcacaaactttaaaaaacaagttttacaattcaaagaattttcctttaattatttttcaatacaagtcttcaagtctgatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcagtttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaagtcacccacggtatttacattaagtcatttactacatcaacacgaggtactaacttttataaagaacatttcttatcaaccagcaaatattcttgcatattgaggacagaatgacttcttcaggattttgcaaataattatcttctcacttatctctggcctttatttatttatttatttattttgtttgtttgtttgtttgtttatttgtttttgagacatgtcctcactctgtccaggctagactgcaatgatgcaatcatagatcattgcagctttgaactcctgggctcaagtaatcctccctcctcagcatccttggtagctggttctacaggcattaatcaccatgcccagctaattaaaaaaaaaaaatgtagagacggaatttcacagtgtgaaagtccagtccagaaaggctggtcttgaactcctggacttgagtgctgctcttacttcggcctcccaaagtgctgggataacaggtgtcagccatcaccccctgcctgcctttatttttaattaaaatgtattagtctgccaaaaagttacagggtttatgtagttacttgttctgttgttgttgttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatttttagtagagactggggttcaccgtgttagccagaatggtctcaatctcctgacctcctgatccgcccgcctcagcctcccaaagtgctgggtttacaggtgtgagccacccagcccggcgtagttttgttttgagacagagtttcactcttgttacccaggctggagtgcaatggcgtgatgttggctcactgcaacctccacctcccaagttcaagtgattctcctgcctcagcctcccaagctgctgggtttacaagcattcgcccattcgccactacgcccggctaatttcgtatttttagtagagacgggggtgcgccatgttggccaggctggtttcgaacccctgacctcaggtgatccacctgccttggcctcccaaagtgttgggataacaggtgtgagccactgtgcctggccagttatttgtaatagaaacgattattaatgttttacacagctttcaaacattttttatacaatttgactttttatcctttttcttttaaatataatatgttttattatatatattttttcttctttttggtatagttactttttaatatgtttcatattaattcgaacacatttaagcttaaagagttctgtgctattcctaggatttatgtatttattagacatttaaaatattttggccttaaaaaaattatttaacaactttctatagggatatctggaaactaatgttgaactatatgtaagattgtctgtagcaatttgatagaaataatgtttacctataaattatttttaatagttacaatttaaaaaaccctctgaaaaattgataccttttcctaaaacattaatttataaatatttatactaattaaaaatagttgaaaaaaataaaaatcacaaaaaaatgagatgaagttttaatactgcctttatcattatcaaaaatgaaagagaaagcgtaggaattaattggacaggttttccaattttatttactgacaattccatctgtattttctgcaattcctcactaacagatcacagaatcttgggaaatgactgattccatatctaggacaggaaatgtgaaaggcctggctcggtatcagcctggttccaacagagggacaaaaccacatgatcatttgaaacgaggaattctaatagaattctaagctataatatcagagcaatcataaagatgtaaggagaactctaaagggtatcctgacgctctgagaaaatatcagaggacagccaagcgtgggcggaaagccttctccctgggaccagcttcagccctccttggaggaggtgcagctgcagcataccctatggaagatgttcacaggttgcctgggttcacattctaacccacattcttcaggaaagaagaaacaaccctccagggtaccagtgggctggaggataaatatgcaggacttggcgctcacctcactgcgttgccaggtctggagcacagtgtttacactcggtgggggtggggggggagtgggtctcaaggcggttgtcatgagcccaggcggcagttgctggttgccaagtgcctgtacatttggtacattagggtctgtatgtgcgtctggggaaaagcaccacacaaatccccacacgtccagagagctgaccatgcagtatgacaaagggaaaagcaaacatgccacgtactggatctaggaagagaagtcttctcctgcaatgttcatccacagccctctactgacaaggctcaaccttgcactcaccgtaaaggagaaaagctctccgggggtgggggcgggggggttggggggcgtaattcctgtgcacagcgcaggaccttgttaagcaggtattgaggcatgaatgtgcgccacgaagcattaaattgatcagtggcagagcccagaacatattgctgtaccagaaaccatgtaagcaatcaaagactaacatgttgtctaaagtacacagaaactgacatgaatgtgtgaggatctatttttctaaacattctttgtcctttttataattccttttgtgatgtagatagcttatttttttctttatttttatttttttcctaacttgtgcgtgtgtgtgtgcacacatgcatggacacctgtaaatattttttaaaacaattattgcgctgctgctttggaactttgaagaagcctggtcctttttaaagagtagtgtggacaaagaacacaaagtttcagttagacaagaaaaataagtttaagagttcgattgtacatagttaataacaattgactatggttaataacaacatattgtatacttcaaaatttctgagagtagattttaagtgttctctccacaaaaaacaagtatgtaggtaatgcatatgttaattaacttgatttagccatttcacaatatatgcgtgtatgtttgtgtgtatatatatatatatatatatatatataaacatcatcatgcaccataaatatgtactatctgtatttgttaattaaaaatatttttaaaaataaaaataaagagtactctagggaagtggaaacagtgaactttgttttgggtttcttaatagaaacaaatccatgctgagtctatcaccctatgcacatactcttcttttagtttctggtataatgaagctttttatttcttaccaacagtctctaaattgtgtgtccttcatgttttattctgccccaattttatttttagcaattccctttcagggatctcaggctgagattatatcaaagaaggtgccacctttctctttactatcattttctcattctaaggtggagagctgtcaaagtgtttttccatttcgtttgtgccaccaagttccctgcttgaaacctaagaaagtatatactggttctggattttctcttggcttaatccagaatttacattatttaatttatctgacacgcatatttaacaatttgtgtcctaatggtgtagacatttccttattttggtgattaactgttccttatgtttaaacattttctctgtttacttctaaatagaatgctcttcagagtttccttatcagcaccacttaatattattgttaagattatggtgaacctaatcaaataacttttactaccctttgtaataatttttaaaaactacttatacagagatattgcattaaaataattacggttcatatgcacaccatttcagttacatgagctatgccttattacctttgaaagcatttttttttagagattgcttcattggttttagtgttcatacattaatatttcacttctaggaaggaggaagagattaacagcactttaaaaagtttttagtggcactttgggaggcatatattaatgttaggtgtttggttttaattgtattaacaaaaacctacccagtgaatttcaaatcagaaatctcaacccaagtcagtctgactctatgatcaacactggaggaaacacaacagtcttgtgcttgtgatagccataattcctggattattaaaacaaggcatcttaatatatgagaaagtatctactataatgttatatacattgacagccctcaaaccatgtgtccactgatttcaatttgtaaactatcatgtatacagcagggtgggaggaaattgttggcttctccttggatttaaatggaggaacatgataggtagccatatatcattctttcagatgcttataggactgagacagacttccagaatttgacagcgacatctgcacgtcccaaaataattatttcatgatgtgtgacactctccttaagggaaattgtaaaatagggctgaccaatgtcccttattttgagtttgaagagtgcatatcccaggaaggagtttggaatcagtcaaattgaccttccttttatttttgcccttaaaatcataaatagcattctttctgaatagagaaacagaaaaacttgtttttcatatttttagttgtgtgcataatctaaagagagctagtctttatgattagcatggaatatggggtaaaaatcactatcattcttggagacagacataaattttaattctggcttacctattgctacattatatgatgttgagaaagttccctaagttaactaaactttttaagcatagtatacatatatgtacatttataaaaagtattttatttcatagctttttccataaagctttacatttatactttaagcagggcacaagaaaactctatgccattgcacccaatagatatttctctcctcagtagagtttaagactgagaatacttttacagtacattgcaataaacattagcatttgagtttcctttggatcagttctacctgtttgtagataatggtatttcatttttgtggttgttatagaggtacttcaaagaataaacaaatattaacttatttcaaatttaaaaattatatcttcaatgactatgtgggtatgtagacacttttataaatctaggatacattatggaacttagtaacatggtggttttaaatgccttgaatattatcaagatacttgtcttggacattttcatgatacatcatcatccaaagaattatttcatcattgtgcataagtttttttcacatatatatttaaaagacatgtaatttgaaagattgtgtattgaaagtttgtgtgaagaatgacaataatgaaataaatcttcactatttcatcattctttttttttaaaattgtgttgctcaaagtattacatcaactttgaaaaatatataaaagaggactggcacaccatcttttagtttcatttctattttcattgactatacatgtccagtaatatttgaataagtgttataaagataatttcaaaatcagggatagtttccaagaattagttttattactgaatatataaatatgtatatatatatatgtgtgtgtgtgtgtgtgtgtgtatgtatgtatatatatgtgtatggcaagcttaaatattgaatgaattacaaataaatttttttaaatatctattatatattggtgcactcaggtatacatatatattaagttttttagtataactaacaaatactacttagtaattctattttgaactatatccatgtggttagtattgtcatttttgcttattttttcatatttacaaaacatacaaaattgtttttccaggttgcatgtgaaatatatttttctgaaagcatatgaattgaatacttttcatattataatcactatatgtgcatacatatataactatggaataaaatcaagaatctctgctgtcataaatctagtaatatattgaggaaaatacgaaaatattaaacagaaacggccaagtgtggtcgcttacgcctgcaatcttagcactttgagagtccgaggcaggcagatcacgaggtcaggagtttgagagcagcctgcccaacatggcaaaaacccatctctactaaaaatacaaaaaaatttagccgggtgtggtggcgtgcgcctgtcatctccactactcgggaggctaagacaggagaatcaatcgcttgaacccgagacagggaggttgcagtgagccaagatcacgccacttcactccagcctgggcaacgagagcaaagctccatctatatatatatataaaaaacagaactttgtccaattaacatacttaccacatgggacatttacagaaataggtgtatagaagatgcagtaaattaaacctattttttttaggcttaaaacaggctaataaatggataatctaaatacattcatatgtacacttcatatgtacatgaaatgaatgaaataatttactatactggtactagaaatatgaaatataattataataaatataaaccataattttatttataataattctagaaatatgttacatctaatatgtaaatttgatatatatttattagaaaattataaaattcatcatttcaaaaattatttgtattttaagaaaactggtgtgccacatttaaagtatcatttattagatttacatgttattatttaaaagttgcttgttatatttgtcaatgtgtctaagtaatcagatgtgtttgaaattcttgagaacattagctatgtccaatttctaaatatataatctacttatagtaccacgtttgaagaaaaatgtctaagctgaatttctgcaggagccatgggtccaagttcacgttcattctgtttttgtgatctcttctaccctatactgtacgcccatacatttctaaaatagttcaattttggttctagggaaagtgcaacacaatagagagcctctgaaatttttatatccaccttttactttcccaaatccttgggttctaacccattagaaatgagtgctttaaatttttaaagtcatttgtatatttataacaattctattactgttttcaaaaacattttggaaaatatttataggcaagatttgatcattatttccagtgaaatcacattcaaaaatacacatagcttaatgaaattcagtcatttcaagaaatattgacaattttcactatgttgcagtttaataatcagtaacagttaagatgtacctatttcttaagatatgagtattcctcagcatagtagctaattgatcaaatataactttggttactaacatttattgaaagagaaatataatttctgcttttgtaaaatccaaatggtccctgactagctttgttgataaattcaaagctacttagaataattgagttgatagtatctgtataactgtttagtatcatgaactctagactgtaaaatttttgaacattagtggacattttttaaagaaaaacagcttatggtatttaatagtcttctgtgtgctctaagaaacctgataattatattagtttattatgtaccagagcttagaagtacacaaataacattctaacttaagtttcacattttacaaataaaaaagtgagcagcagataagaaagtgtgtgaaataaattgtgaagtaatgataatgtatttcaaaatgagtatgttctcataagtgtttacatatctaataatttgtacaaaactcagttttatttgtgttgctatacctggtatagcaattaaacgctacgaaaaaacattctggtgtattttccctccatatgtttatgtttatgtctcattttacctttacctgcatgatgaataaaaaaaaaaaaacttaaatgtgactaacctatagaattaatttttttaattgtattggcaaagtataaatgaactactgaataataaatatactataaaagtaaactactgaatcactatcgttagcaaatttttaaaaacattttaggaatttgaaagtagaaaacttgaaatttgcatgcttttaaaaattaaaataaaatattattatacaaagctcacaacataaaagcatgtaattaatataaatagaataaattttttgatgttttaaaataagatgaatgcataacaaaaattattacatattataaagcttattttatatatataatttgtatatatattgaatataatataatatagaattacaataattatataaattataatatatgaatattaaagatgttgatatctattatataacaatattgtataatatatgaagaaatttcatattatgaaacaatgatatattgtttagactttgtaatttataatgagtccttacctgaccagagcctgcattttcacaaacataagtctcatagtattgagagaactcaggagcatgatcattgatgttaagaacttgcacatacagtgggatcgaagagatctgttctatattgtctgcaatttgaatatatataataaaaatctaacatattttaatatgtctttagaagagacatcattaaaattacattagaggctacgtggtgtatttttattttacttgaaaaaagcaatctgaggacaggatatctatatgattcacctacttatcaacaatagatcctagaaaaaaattccatgctcaatatattcaaaccaagcaatatttattgagtgcattgtatttgccatgggctgtaataagtgatgagaaaaagcagtaaaaagataaagtaaaataagggtatacggagagcttgcaagagtccaggaaccatttaaagttttgtattaactcatttaattttgatcaatatatggattattatccccccaattttacggataaaaaattgataaaccatttagtttcaaaaattacagttaaattacttgtgtaaggttatagctgcagtgctataacaaaaaaaattctgtgaaccactgaaatttagggcgtagcttttaaaaacaaataattagaatctaaatatattttaaagtaaaatagttataataaaatctaaataaagtttttatataaacattgaattgagaagattttctaagtgagccaagaaatccaaaaaacataatgagagaaaattgtggttaaaacatttaaatctttcaaattgatataaaaaagacatttcagaaaaaagtatgaagtaggaattcacaggagagaaaattcgatttatcttatagcagactttctcactgctgtcactattaatattttatactggataattcttagttttgggagattctcctgtgcattgtaggatgcttagtggcatccctgacttctattccccgaatgtctgcagcatccctcccatcccagtgtgtcaatccaaactgtattcagacattgtcaatgtgccctggttgaaattgggggcagaagtgtggagccaaatggcctgtagtggagacacgccgcgttatcataatgttcacacagcctctcaccacaggtaagaagaatgatggtttagcccatgccatttttgtcatatgcgatagaacagcacccagtgatagctgagtgctgaaaaataacaatgtaaaccgactctagcaatggataatgaaatttaaactacacatatctgtgacccaatctgttaaacttaagctacagtctaaggtatcagtatttgagtaaatgatccgattaaatacattccagagttatttgcattacatccaaattatataaacgactcaaatgtacaacaaaaaagaattggggagaataaattacaactgaactatgatattatgtggatttattaaaaatttgtgagtctggccaagcatggtaactcacacctctaaatcccagcgctttggaaggccaaggcaggaggataacttgaactcaggagtttgagagcagcctgagcaatatagtgagacctcatctctactaaaaatccaaaaaaattagctgagtgtagtagtgtacattgtagtctcagctacttgggaggctgaggtgggagaatcgcttgagcaggaggttgtggcagcagtgagctgtgatcgggctactgcactccagcctgggctacagagtgaaaccctgactcagataaaagagtcaatgtaacacatttttattgtgagctctaaaactggatgacttgagtttgaatcttgtttctcaatttgagaaaaatacttaaccagaatgcctcagttggcattctgaaaaatgggtgtgatagtagtacctgccttatagggttgttgttaagattaaacatatacataaagcaattgcataaattacatgaagcaattacacaaattggttaatatacataaggcaattaagagtacttagtacataactgaacaatgaatgttaaatattattgttttgttgcatctactaaccagacatgtattttgtgaactgaaaaaagtaagttgcagctattatattgtgtaggtttattgtttttaatctttctctctctcaggctgtagtgcagtggcaggatcccagctcactgcaacctccacctcctaggctcaagcgattctcctgcctcagcctccctagtagctgaaactacaggcacatgccaccaggactggctaattttcgtatttttagtagagacaggcttttgccatgttggcaacggtgatcacaaactcctgaccccaggttatccacccaccttggcctcctaaagtgctggaattacaggcttaagtcatcatacagggcctctctttttcataaaaaaaaaagaaagctataggaaaggtgcatacaattaaagggtataggagtgggattctttagtttgttttagtgtttttatttaaaatatatgtactatttgcaatgataatttgaaagaacaaaacaaattaaaaattagaggccttgtacttgttgaaagcaagggaaaatattttttctttccttccttttctcagagcattcatacacacacacacacacacacacacacacacagagaaagagagagagagagggaaaaaaaaagctttgtatgtaagttttttctttgtccctttgaagcgtatggaaatctttcaaaagttcaacaagtttcttggaagctttaggatccaggattgtatttatcaagtaatggtgaccatctctttgaaatgtaatcttcaaggaatacagcatccctatatcctagatgtggggaaggataggagactcattttagcaacgatcttgttctaagttgtagaactacctcttgtcataaagacatgaaaagttaagttgtcctttggataaaaccacttagcaaatacaggcggtcactccaactacccagtgaatatagaatgaattctatgtgacaaatagtgctaagtcctcatacttgaatatctagataatatttaacttgagaacatgtatatattggattgcacctgcttgaccacataaaaaggtgagatttctttccattttggcaatctcttagatttcctatgatgcagatcacattgtgttttaatgctttccagtaataaaatttttctctctgttctacctttgaggggaggttttctgggctgggatgagattttgcttaaaattgaattttcccaacaataacagttacaattaagatagaaattgtaattttcaattaactaaaaattaaaatttctaggatttattacacacacacacacacacacacacacatccatggcctttaagaaatacagcaactattagtatttatcattttgagacttttctccattgtgtgacatttaggatgaaaataaattaatggaacatttaaaaatgaaaaggtatttctaaagatttcaagaagaaattaaccagaaaatttaggttcgtatttgttatggtttcagcgcatacatcatcacagaatatctttttgcttaaataattaaattgtataatgtaattcagttgtgaataaactgacagaaaattaataagaaattcataatgtttttatctttgtgttcctaaactttgcttgaaattaagttaaattaaacctttggtattactgcacaaaatgtatataaaacttcacagcttcaccttaaaatagtagttttattcacttagctagcatactgataaatagcattgtgcttaatttgggaagctttccagaaaagagactaagcacaacgaacttcatttgctggaaaaaaaaaatttttaaatggaacatctctttcctataatcagtataattgctatggtgaaagcttttcaaggtagttagcaaatgcagctagatgatttttaaaacagttttatgtaatgccctgttttccaccagtaggtggtttgtttatattgctattgaagcttaaatggtcaagcctaattatttttggttcaatattgatttcacagtagtaaaaaaatggcagttacacatattttccccaaatagatctaaaatgggcttaatgatgtagaattttttaaaatgttagagaaagaaaaaaaatgaaaatttgttatccagtgttataaaagcttgttccaacaagtttttccttaaaatgaaaaaaaaaaattgttctcagaaatacacaatgaataaaagctgcatttaaaataaacatctttgcattttctgacacgagaagccttgacatttcctctgttacagcgggcatttattccattgtaacatttgcctccttttatggtttagttaaatggaaccttgaaaacccagattcaagctctcctacagtgtttccatagaactgttcattgtatcgcaaataatatgcggagatgccttccactccaccatatcacctgccatctgcctgataaagtaaggaaaagagagatatctgctccctgcctcaacaaagagtgaagaaaggaaacaggattattaaaattctatgtaaaatcagctataagaaaagatgcatctgagaatattttatatttgtaattttaatactttacaattctaaatctattgactaagtaatggaaatgacttcgatattttatattgtgttatatttatttctttaagctttaataaatataattgtatgaataatggattcatgattttaaggacaatatccaagtggtaaatcagaaaaatttacaacccgaaaacgaaatcatccacctaaataaacaagcagaatttcaggtgaatttcatttgtattttgttgtttcctcaatttattcttgtatggaaaattatttactgttataattagaaaatagtttagaaggtatttagtggtaagcatataaataaaaactaataaaatacgcaagtacacacatttacattgaatgtcatttaaataattccaacaacattttaaagtagccttgtccccatgtatagaaatttgtaattatttacaaaatatggcaaacaactgtattggatttcaaatgagtacttacatttttctgtggctgtaatacttaggttgtaccaagcactgatttcacgatccagtgagttacttgtagtgattgtaccattatcattgatattgaacactttgctcctagtaatagaatacctgaaccaaaaggaaagtataccttaatatttttattctatctgcataacagtgttagataatactctttaagcaataagacatcttattcaatgcatgctctacatagccaatatataataccgaacaacttttaaaacagtatattcctgtatttaagattcaactcagtggagatagaaaaaaagacgtaacatgactttagatttaaattgatggatgctaaatctaaaattaatgattgtgaatctttttttcctatcaaataaattaaaatatatcttcagcctagacgagtattgatctctttcctatgtcacaggtgttgcttgcgaatctgttcattttactacaactacttggcttgatatttaacaaatgtttttgtttgtttaaaaagtaaatttgataaaaagtaaagtctatatagtagatagaattttaattcttttgggaaacctgaaagacttctgaaatctggaatctggaatcaggaatccaaaatatttatatatatatatatataaacatatatataatacattatatatgatatatattttacattttataacacatgacatattttattacatatataacatatttgtaatatttaatacatatatgctttattctatattacatatagaaaatatgtaatacataatacatatatgttttatgcatatatatgtaatatatgatacatatgttttattatatattacatacaatatatgtatgtatatatgtatgtgatatattacatcacatgtatttattttatattatatatttttacatataatatatatgttttatatatatacacacatataaaacaaaagtaaaatacagtagttctaatgtgcttttagattgtgcatggaagaaagccaagttacaaatttctcccaagggaaaaaaaaaactgaaaaatgatctccacctccacaatgaaagaagacttcgaaatactcagcatgtctcatctatgtggaaacaattaataataaaaattaaagagcaataataactagggttcaataatggcttctcattgcatgtatattcctgaagactttgatgagatatcaaggaagtttaccataattatatggcaaagatgagaatattttaattttgagttcaagtatttccaaaaacattatgctactttgtagctaggtattcagataaggactcaatagaaatcacgaggaattaagctttaggggagttcagttttaactgtactccatttaaaatatttataagtattttccctaaatatccccaagtggttgcctttcacacctaatagaattgttggaaaaattatacagtgttttaacagttgttattttgaattaaacatctaatcctatttctgtaaaatgtcattgcacataaagcccatttaaagtttgacaggatgttatagtctttagtagtttaattcacatctgttagaatttaggaagaagagccacataaacaataaattggttcagttcccattaattaattaaaacagaagtaaaaatatatgtagcccctctaggatgtgatataagcagtgatgtgtaatatgtatcatttttcttaaccccttttagaaccacaaattctcgttatgtaagttttcttttcccccactccaccttcactggacaaaatttgtttggctttgaggtaagttttagttaaattttacatatatgtaaaatacatatatatatttttcccatttttaaactagggagacaaacatcagaaaattcataaatatgtaaacagctgacttatttagatatgtaccatcatgacctcagcaaaatttaaaatttggaattttcccactaatccaattaaaaacattttacaataattttggacttacagaaatgttgcaaaaacagcacacagcatttctacatgctcttcactcagctttttctaatgttaaaatcttatataaactttaatctgtttaataaattaatcgctataatttaattaatcaaactacaaactatagttggatttcactgttttttttccactcatattcttcttttacaatccaatgtagaatccaatacggcctttcattttcctgcgtccttagtctcctccacgattcctcaatgttcttgtctctcaagaccttgatgctattgaagagtattggtcaattattttaaagagcgtctctcaatttgggtttgtctgatgctttctcatgattagactaaggttacatatttttggcaggaataacacagacatgatatactttcttaggctatcatatcaggggaacatgatgttcatcatatctcatgaatggtgatattaacattgagaactcgaataggtgatgacgaccccatttctctggggtaaaattgctatttttttcttctgtaattcataaggatctcaggaaactattttaaaatgttctggtttctcaaacatttatccactaattttcagtatccatagaggaataatgttaacattttttaatactttctttctggaaccacaagatgctccaggatgatcttgtcgtttccttacaacagctctggattccagttatcagatgagttgcagcatctttgattggagagtagtattagaaagcaagatctaggtattaagagttcccattgcttcttgagtttcattgtttttaggtcctttgagcagacatcagcaggaaatatatgtatgtatacccatgcgtacaaacacatctatatttatttccatgtaattccttctgtctgtatatatattaagaaggcattcgtgcatcatacctcagatttcaatccagtgtgacaccttcatgtaacttttctcattttttatttgtaatcatttcttttgacaataatgcatcttagtcttactatctacagcatatttacttatgtgttcaatcccaatatacatgtagagtaacactgcaatccctaaatagtatccatgtaaaaaatatattcactatgtagagtacatttcttctgaacagctatttttttctctagatttagaattgaaatactctcttccaaaattacttaggttgtattttcctaattcctctccttttgattatgttatttgtctataatataataaagtacatttgcaatagtttgccttcaattttggggatatctccaaagtcctatttgatttttttccagagtttacactaattagtattttcatctatatcttggagaattctctgaacttggacaaaagaatagtcatgtgtccgccttcacataatgacacagaacaattttatcaccctcctttcctttgtcatatctttttagtttaggtaccacagggtttatttttgtttgttcattttttttaatccactcacctattgaaggatatttgagtcaattccagttattggagatcatgtataaagctgccataaatgcttgcatacaggttttcatgtcaaaataaatacactttctaggcctgctgcaacaaaacaccacaaactgggtggctgaaaacgataaattaactctattagatttattaaaatcaaagtatcaacagggtcatgcttcctttgaagcctgtaggggtgaatccttccttcctgtttctagcttccagtgatttccggcagtccttgctagtcttccacttgtagacgcatcgctctgatctctgcttcggttgtcacatggcagtcctctcccagtgtctgtcttcttataaggacaccagccattttggattaaaaacatacctgctcaggtatgaccttatcttaactagttacctccacaattactctatttcttaacaaggccacattcgggtgtactggatgttaggactcaacatgtctctttaggacacaactcaacccaaaacacaaagtttcctttattcctgggtaaatgcttggaagagggattgctgggtgttgcggtcaatataagtttaatttataataatcttgtatctttctgccttgataaactcacatattactgggcatttttgtgaatttcctggaattatctaggcaataatcaagtcatctgcaaataaagaaaactatattatttctctccagcttgtatgtttttatttctttttctcacttactgcatggccaggacttccaatattatagatttggactagtgaaagagtacattcctaccttgtttccaatcttaggaaaaaagcacataatattccataattaagtataatattagctgcattcttttgtagatactctgtatctgtttaagaatcttctattcatattgtgctgattgtgctgatagtttttataataagttaattttgaatattgtcaaatgttttttctttgtctattgagatgttatatggcttttcttttttaatctctcaatatggtggtttatatgaaactattttaatatatagacacatccttgcattcctgggtgcactccagttgataaggatatactttccttttcacaaatagctcaaattactattattgtaaagaattttcatatttgtttatgagggatattgatctgtagttttctttgcttgttacgtatggtaggatatatcagtggcatcaatttttactggaactgctctttttttatgaagctatttaactgactttttggtggtatatatatgcttgtgtgtatgcatgtgtatgtatacatatttatgaggttgtacatatatggttgtttgtaaatgtatacgtgtgtgtgtgtgtatgctaaggttatttatcttttaatatctttggattctctcaagaacttcctctaaatgtataggcatagcattgttcaaagtagtccctataatctttttaatgtctgtgggatcaatatgtgtgctccctttttcactttggtaataataatttttgtcttctctctctctctctctctgtttgccccttggcctttctcgatagagattaataaactttagcaatattttgaaagaatctgctactggcttcattatattactccgttgctttcagtttcactgcttgtgatctaatctttttatttcctttttgtcctgcttgctttgctttttatttgctcttttttttctaacaggaaataatacaccatctttctcatacttacaaaatatttcaaagtttgactttagacttaatttgaaaggaaacttcaataacgtccaaaaagtaaatcatacccattgataccaaaagagtaatccctatatctgaagtccaaaagaataaggcaattgtcttagtcatcacagacagctattaaaaattaccatagactgggcagcttataaacaactgatatttatttgtcacatttctagaggctggaagtatgagattatgatgccagcatgattggcttctgacaagagcactctttcagttgcagactgttgacttctgtgtccttacagccagagagaggcttgagagagctatctgggttccactttaagggcactaatcccattcattagggctccacctgtgtcacttgatgccttataagacccaccttctcgtacccacctaataccatttcattgagatttaggatttcaaaatgggacccaccttgtaataccatttcactggcatttcagatttcaaatatgaattttgagggacgtaaacatttagacttctgaaataatacatagtcttagtgataaaataaaaattttaagaataatttcttatgaagttcttaataattttatggtagtaattttattacagattgtttgggctcctctaatttttaccatacaaggctccttaaaacaattctatcatctcactttcaagtctaaatattaaatttttccattatttctgtgccccattttttaaaaattgacatgtagtttgttattataattcatataaaggtagatcttgctcctcaagcttttatgacctcaactaaagcaagagtatttcgttacaccagtttatttaccccacccaagacgtgatgaaactgagtttgggaatttccatgctttacagaaacagcaggtgattcttacttagtaggaaaaactaatatgagttgaatgaattggggctaatttactatgtttaatatgtgttagtgtttctcccacaacaatgagacatccctaaggctaaaatacaatatcctaatattttttctggttttcatagctcttaccatgcagtgagtattaaagaagagatattatcaaattaaaactcaaattgaaatcattttgcattttatgttcaaatattttggggatcttttgcttacaaagaaaaaagagataaataaagaaaaccaaaaagaagcctcctgaaatgtgctgaagtgggtattttcataagcaactgattttgtttttatgatgtattttgaatgtttgttaaatcaagctatatcatatgaaaaaaatcaacaatatcaacaacaaaaactgctgtatcctcagtgatcctaacatatgtatgaaaagcaatattatttaaaagacacttttaaatgaaagaacatctgtcaaatcattaaaacgtgttttttgatggatacaagttattttaaaaagtaataattgccagtataaaggtggaagtcattagctaaaatattttcagattgaagtaagtagacaccaatggtgatactataaaatacaaaacctcttaatatttggttgtaccttaggtttttcttcatatatatgtagcattttcacatgtagtaagcatgcaattcttcattgtgtattattgtgctttaaaatgtatgcagtggtattacctatgcatcacaagcatcatgaattataatttactcacttgtactcctaaaattaacagttttcaatactttattactataaatgataacatatgaatatcttaatcatcaaagcattttttaacattccatattatttagtgttccctgaagaacaatgaataggtatacagatacattttttaaagtaaaaaattgatatgcacttatacaatcactaaaatgtctatgactaattaagaactacatatgcgtatcagaaggcaacattttatgaactggaactataatggaaaagtgggaacatttcttggtatcaaaaattaaattgagctttttcattgagctactgcaagaccttcacagagccaaggagcagctagcattttaattaatatatgaaggtttctggaaaataggtgagtaaggaaaggtgttggagaaatcattacgtaacaagctttggttttttatgcccaaccagactatacctcaactactgaaacaaacaaataaacaaaatataaaacaaaagcaaaataaattataacatagtaactgaaaataacagactattttaatagatggcaaatatctgtttaattgtaatacaagaatagatttctaaccctttgaactcctttaagtggtatcctgtaaaacacaggttcccaacccccaaggccatgaacagcaggccatgaacctgtccatggcctgtaggtgagggcaggcgagccagccttactgtctgagctccgcctcttctcatatccacggcagcattagattgtcataggagcatgaatcctgttgtgaactgtgcatgtgaagtatctaggttgagacctccttatgagaatccaatgccagataaactgaggcagaacagttttattctgaaaccattccccttcacccccccgaccttggaaaaattgtcttccaccgaactggttcctggtggcagaaaggttgaggaccactgctataaaagctttctcaatttttgaatatcatttcaagtaaatagtatttaaataagccacttttttgttgtcgttgagacggagtctcgctttgtcacccaggccggagtgcagtggtgcaatcttggctcactgcaagctctgcctcctgggttcacgccattctcctgcctcagcctcctgagtagctgggactacaggtgcccgccgccacgcctggctaattttgttttgtatttttagtagagacggggtttcacatgttagccaggatggtctcgatctcctgacctcgtgatccgcccgcctcggcctcccaaagtgctgggattacaggcgtgagccaccgcgcgctgccttaaataagccacattttgatcagctttgtttcagctctaattggggctttttaaaaaacgattgttttcctcttatctcctttccccaattaagagggaatataatgcactgaattttaattggtaattgcctccttcttgcacgtgtttgaaatcaccaattttactgcatcttaaccgacactgaggttccctattttgcttaaattgttacaaattaattaagacatacagaaatatagatacagatataaccttgtttaaatttgcacgcaggctaggggcggtggctcaagcctgtaatgccagcattttgggaggccgaggccggtggatcacgaggtcaggagttcgagaccagcctggacaatgtgatgaaaccccgtctctactaaaaatacaaaaattagctgggcgtggtggcgcatgcctatagtcccagctactagggaggctgaggcagaagactcgcttgaacctgggaagcagaggtggcaatgagctgagattgcgccactgtactcgagcctagaagacagagtgagactccctctcaattaaaaaaaagattgcatgcaattttatttttaatctattttatatttacttatttattaatgcaaaactgaccttacagacatacctgataggagatttcctattgtctgggtctgtggcagacaccacgcctacaaatgatccctgtggggtttcttcaaaaacttcaaatacataatatggaaggaggaaaagaggaggctcatcaacatcttccacctggatcttaatgaaagtggtggaagcctcagtgtggtacttcatgagctgctcaggaacatgatggtttttaacttttgctctaataccgtagtggttctggtgctcaaaatccactttctgcaaagaaacacagtatacacaaaagaaatggctttagtaacccaagatactatttagaaaaaaggttttacctgttaaattaagtctcagtggcctttcagttagatttttctttttatgtacatggatctctctgatataattgttaatcaggcataacaaatctgggtgtattgtcacttacctattttaatttggagataaagttatacttttgaaagcataaacatctaatgaaactgagaattaatttcctagtatttaagatattttccaaaaagttttattattagaattaaaaaaatgttctgcatataattcaaaacactctgtaataactctctcatctctaaaatccttgtctccataaaacataaattactggttctcatttcaattatttaatgagttaaaaactaaccagctacacaaaatatgttatgttttaattttgcgctattctgcaaggcaaataattttaacatgtctaccttttttaatataactattccttcttgagtttcatgattagtaataatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtatggctaccataatctgagtgggatcactaattcttctaattcttcaaacagtggtgtttatatcgaataagcaaggttttggcttgaagaacatgaaacctggatgtgtgggtacatgagatgggaaaatctgttggaaaaagaggttcagaggaggggcagctggaatcaggagttcagttaagtgtgtgttaggttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggttttaaatgtgtaatatatatgtgtattatatatgtaatatatgtgcattatatactatatatgtgtattatatatattatatatgatatatattgaatgtatattatatataaatatattatatatttgttatatattatataaaatattatatattatatataatatgcatttatatgtaatacacatatataatatatacaatgcacatttaaaacctaatatacacttaactgagctcctgattccagctgccccctcctctgaacccctttatatatatatatatatttttttaaaaatatataatatatgaagttgatgagtagacagatttacttttgcgaagctcaagggagaagttcagtctggagatgtatatttaatatgaggttctcagcccagaggtggttatgtaaagccacgtgtctggataagatcataaaggaatgagtataaaagggaagaaagacgagatcaaaggcctgactcacaaatgttccgaagtttaaagtatacaaagaaaaggcaaggaaggaaaaaacagagactagtaagacagaagaaaaagctaatgagaatggagcattaaggttttcaaggagaagttgatcaattacataaaattcttccaagaaatcaagtgttatcagaactgagaattgacactgcattccacttaggttattgatagaaatgatcagatcagtttggtcaagtagtgtggatgtaactcaaacggagtaagttctgagattttgaggtcgttaattggaaacaataagtatgaacaatattttaaataaatcttctctaaagagaaaggaagaatacaaagcatctttagctaagtatggaagtgaaggcaagaaagtgtttttgttttgtcttgttttaggatgtgagaaaaaacaataataaacatgtttcgatgtgatagatatgaaccagcagaggacgctgttcacacaagggagagggatgtttgagagatgcctttaattgggagggtaggaagtgttgcccacaacagagggtataggtattgagtatttacattgagaggagggtaatgggattcccacaagggaaaaccatgtggacaagagtaaggaggccagaatcagattcacccacactcgtatatgagtgaaagtattaagaggaataccatcatctcatattcagacttgagtaataaagataattttaaaagatattttaaatattctaatttattcaaaatattttaatattaaagtcaggaaaaatcagagggaaactgagaaaggtagtagaagcttcaggatattttatcgcagcaagttccttgggaattttcctgtcttccagagtcttctacttgctatttaataatcatctgcataaatttagaccaaatttatttaataaatccagacactatttcccacatattatatgccaattattttataaagttctgggtatttcatatttaacttggtgttctcctcttgccttcagaggccatattaatgttgtggacagaagacaacatatgtatcatatacatcatatgtgacactacacagagagagacgaaggtgcagactctgacccctttgcctatagtccatccacagaggaactgttttctcaacccatataacagtggtaattttttaatatgacaaaatttaaaattgtgagatagagcagaaattaaaaaatgagatttgtgatatttattgaaaaatcaaaagatctgataaccttgcatatgttggctacactgagtagttgtctgtatcatttaggtgtgggcatttgtgtgtgcgcacacacattaacagatattctcaagtctgtacaactaatgaatggaaaattcagggtttaaaagcaaatttgtatgatgccaacttcctgtgcttattcatggactcaactactggaaggaagtcagtgaaagtagcatttcacttgggccattaaaaatgacatgatttcacttgactttgaggaatggggcaaggaacagaaaaggatgaggaaaaaaaagtaatcaaaagatagttttgtttctgtctataaacaatcaataactaagaaatcatgctatggtatatatttttattggctcttttctttgttccatgctaattaaattttcttcctagcatgataattacttatgctttctggaagtgcttataaatgtattcctgtagctaaaacagtataacctgaaaaataaatttcctagaaaagaaattcctccaataattgcataagaaaattttacgaagcataccatgtgtttatgtttagcttgcagtaattgcttaaattattagagcaggtgtggcctattctggcttataaagtaaaaagaaatacaaaaagtcatttttaaatgattatctatggtttgcagaagaaggaccccacaaagatatctgtgtccaaattcccctgaacgcataaatatgtcaccgaaagtggcaaaagagaattaagtttgcagatggaattcaggttgctaattagctgaccttgagatgggaacattatcctgctttatccaactgggttcggtctaattacatgagtgcttaaaagtggaagaggcaaatgtgtgggttagagggttgtcagtgtgtgaagtatgtgacactccttgctgcttctgggatgtgtgggctaaatcaagagccataaagaggccttcaggaattaaggatgtctcccagcttacagccatcaataaaacagagaccttaactctatatacatgtaaactgaattctgctaacccttaaatgaactaggatcctacagcaagaaatgcctccctgaatcctttgatcataacccaatgagacccataatacatttgttttaagccatgaagttagtggcaatttattacagcaagaatagaaactaacacattattctttcatttgtatttaacatttaacatgaattaaaataatcataccagaacaattgacaaatttattttatataattttagtgttaatgtagtgcttttagaatgaaaactatataatctacttatatttaacacactcatatttataatgtaatgaagatgtagaatcctttttacttactttctttaaatataggcttattgtcattaacatctgaaagtttaattaatacacttgttgttccagacaacgctcctggctgaccaatcatgtccttggcttgaatgattacccaatactcatcttgcagttctctatccattttagaagatattcttatgactcctttaaaaatataataaaattccaattatttcattattaatcatgacaaagttctagttaatttcttaaccattgcagtatacattattttgctatatgttgaaccactgcaatgtgacagagacttcactagagaaaaataataaaaaataaattaaacatcaacactgcctagagtctagagtgatcatcacaatattaggaacactggtaggcccttaataaaatactatgttaagataatccacaggtagaaaaaaaagaatgtcttgtttttactttaacctattttctgctatctcttctaacataatatcggcttgctacagttaactttgtccccgaaactctgaagttagtatattattgatagatttgtaaattataataccaaatttatgaaataaatgtcatgcccttattattttgaagtctacttagaattatgagatctgaagaagacctggttgttgacccagttattttatgtgtgtgtgtatacacatatataatatattcaaactcaagataattaatgataaatattgcaataaatgcttaaattctataaaattatttaatatacatttattaactatcactgaaaagaacctaagaaaatcttaagacaggttcataagagaggactcaacatttctaaagatttggggaacacataaacagtcacaaaaaataaataatacccaatacccaaatatatcaagggcaaaatattcattaaaaattgtgatattaatgaacataaagatggaaacaatagacactcaggactactagagaggggaaggagggagtgggggagatagttgaaaaacttctgattgggtagcatgctcactacctgtgtgtgacgggatcattagtaccccaaacctcagcatcacagaatttacccatgtaataaacttgcacatttacgccctgaacctaaaataaaagtaaattaaagaatacaataaacttgtgaaaaaaatgacatatgagtataaaatgcacacctgatttcaaagactgagaacaaaaaatgtgaactatctccatagttttgtattatttgttgaaatggtagtatttttgatttattggactaaatttaatataatataattttttaaagaattgttatatgaacttttaaaagataaattagaccataacatgaggggattttagttgcggactaaagtgtttcacacatgtaatcaattatttgaatccaatggaaagcattcaatatgttgcacaagtgctgctagcgtctccctgtatgtgactcaggggagagggacctaggagtctttgttccccattaactgtgcctactttgctttcaacttttcctctcagccttttgactgaataaaggatatgtatttctggatcttatgcacttcagaacttatgctttcagtaatttaatccatgtttgtcgttgtccataccaacgcttctccagcaatgcaagtaatagtttagctaacctgctcagtatagttaaaaagtcagtgtgcagggtaggggctgggggtggaaagaaaacatggtcacgaaggcctggtatgacccagcatgggtttgtactctagacacctccctttcttctctcttctgcatttctccacactggtgttcagttattctaagagtttcaactctttcccacctcaggaatttccctaatttttcccatgccctgaaatcatcttccactctcccttccttgtctacagactcagctaaactttctgatttccgtgtattctgccttgaccacacaacataaagtcaacctgacttgttttctcccactgaaactttttggttttacttcataagtacctacagtggaatgtatgtgtgtattactattcatgtttaatatctatctgtaagttccaagaaagaagagtccattattatatcttgtttttgttactattatgtattgttttaaattttgcaatttgtacctttataaatctagcaagttgtataacatttggtacatattcagcctttctagacctgaatgtgtgagggaattaaagtctaatgttttgaggcattcattgcatataataaaataatttttcttccatacatttgaaaaaataaaggccatgtacattcctgagagaattaagaacataggtactcaaataatattttttagaatctgactctctcaagaaaccctaattgaaaaaggctgagacattcaatatttgctgaatgaataaataagaaatgtttaaagatccaacacaatactttaattctttaagggttttgatataagctggaaatagtattttccttgtattaaaaaccatagaattttacttctttggcacttctcacgttcttgggtgattagttatatatatatattttttcagtggagactataatcttctaaaggaaaaaaaattacatgggcctaatctttgtttaaaacacaaaaattaatttttgtttaatgaattagggtcatatgattgtttaaagaaaagagaaaactgtgttctacttattttatattcaattgattaatgcagattggtagagcaatattacaaaaagaatcaaatattgtattcatgtaaatcagaaatctgtaaaatacagaattatttttaggtgaatgtctcatatcaatgtgtacgcttagccttatactcagacttaatctcagtcattctgcagggttatgcagctgtatttcattgtggttttagtttgtattccctgatgactaatgaggctgagcatttttaatatgcttactggctttctgtatattgttctttgtcaattgcttataaatgttttttccctatatttttaaattgggttgctggtctctttttctaattcatttaaaagaatctttacatatgatttaaaccacatacataagtaatttgtgctatggacatgaaaaatccagtctcctagaagtatcagctaaaagactaaaagtaattaaatgcttaggaattgcaatctttttgcttattgacatatcaggactactgtaaaacatgtttctaagcagataatttttgctgacaattgccttctttagaatcatgttaaactttgcttgtttcattcacaaatacctgttgttggttcaacagaaaaatatggctggccttgaagtaagctgtagaggagacgagcattattaccacttgagggatcgtcagcatcacttgctgtcacctggataactaatgttcctaaagagaacataatacaggaaattaagattgtggttttattcaggatgaattcagttctgtgaagcggtctttctttaccaagcaagatgttgttacaaaatgaaagctcaattcacctccttgttcttaattgtaaaagtaatgtatttttttgttgttttttatttttttcaggcaaaagaatataacttttaatacaaaatattcctaattcctgtatgcaatatggaattttaaacatgtagattgatggcctaataagatgtagctattaaacaattcattgtaatgtataatttataaatcataaacttttccaaggtgtattattagtggagaaattaaaaggaacttggaaatgcttttcaccaaaaattatagtgtagcctgtaccttaaacaaagtggagaaggttgataaatatttacaaagattattgaattgagcttgaaagagtatccagttgaggataaggatgggcataattattcagctcctttaattctcttctctaatatacctacttcctttgatgaattttttaaaaagcaaagtaaaatcttgcagatattgataacataagcattctcattaaaattcagtaacaagaaataaaatcatatggaataattatgtatacatttaaaattagtgctcagatttttaaaatatttattcaaaaatattgagttttcaaagtatctttctgtaaacatggaattgaatgttatggatcttatttgaaatatgtatttgttgaaacactgtttactgtgtcaataagaatagcaacacgaatgacacaaaatcaaatagcttctgtggttttgtttacaactagcatcatgaattttctcatcgtagcccaattttataaactgatacactctaataggaatccattctatacttcactaacatgaaacttttgctgtggccctaaatagtacatattctttgctcttttgtcttaatatttttataatgctatttaacatttgttttaatatcatacagcatattctattgaagtagaatttcttcttattcacataattttatgggtaatacttttacctgattcaaaatgaatcaggaaaactttttgcctctcttttccaaaacttattgaataaccactcaatgtgtagacacttactagtttcagatgttttaaagtgaatttatttagtaatttgtgaaagtttttccaacaaaatagttaacagggaccatcactttcattgatccatattgcgcaagacttgttcctttaactatccttctatgcaccgatccacttacttatcccacatttcctcattataattctctatcatttctttccataaggggttcccatccctggtttctagaattatatttcctatctttggcttcagatacaatcatcaaaatcataccattttcagagttgactgaaataaattttagtaatatcagtctttagagcccctaagctagtactatacaaatgagaaccaagaagtccagaaaatgcaatgactcacaaaaggtgacctcacactttgatgatagaaatatgtcatacagttaggttcttttttccagtccagtttttttagcatgctttttctataaaataaattttattatatatatttaaggtatgcaacatgttatgcatatagatagtaacatgattactatagtaaagcaaattatatctatcatctcacaaagttacccatttttgtgtgtgcatggaaagagcaagtaaaatctactcactcatcacaaatctcaaatataatacaatattattaactatagtcctcatgttgtacattagatctctagatttgtttatcttacttatctgatactttgtattctttgacttacatacctccatttcctccctcttcatatccccgacacattattttattctctatctttctatattgaactttttttagattccacatataaataagatcatgcaatatttttattctgtgtctggcttatttcacttagcataatgtcccccaggctcatccatgttgtggcaaatggtaagattttcttctttgatgagacttaataatattccactgtaaatatatgacacagtttctttctttattcctctatctgataagggatttatttaagagaactcatacaactcaatagcaaaaagccaaataatcagattaaataattggcaaagaacctgaatagatatttctccaacgaagacacacacaaataaatggccaatggttatatgaatgggttctcaacatcactaatcatcatgaaaatgcaaataaaaactactatgaaatatcacttcacacttgttaggatgtctattattaaaaagacaagagaaggcaagtgttggtgagagtatagagaaaagggaacacgtgcactgtaggtgggaatgtagattcatgtagccattatggaaaacaatatggaggttcctaaagaaattaactataaaactactatatgacccagcaatcccactactgggtatttatttaaagaaaatgaaatacaccactagtaaagatatctgcattcccatgttcactgcagacttattcacaatagcaaagacatggaaacaactctcatttctcttgatttccctttgtatctgataccagtgtgtactccttacacacacctggattattgtgcctgctcagtaacctactgtacacctgttctctcaggtctcctcttgatcacacccatagaaagcaaagaggtagtgacatgccagagcaggtgaacattttttactgatgcttcatttacttgtaaccaaaagttacttcttcagtgtttttctcctgttgtctactaagtggagaatctaatgtattctgttaatagattacacaaaataatttccctgagtgtgtagaaaatctaaaaggtcaaattcttagaaattttagtggaaaaaatctgtgatattataaatattcagaataccactcacacatgaatttgatggggattttaatttctggggaaatatttgttattctttcttatgacacttgtggcattttaaaagaaccaaggctatagaattggtgtaattcaacaatgttttagaaatgcttactttttggtaaggactatcaatgagtattaagtgattcactccttacattttttgtgtgtgagaagatgtttatgtgtatatataggcatatatgtatacaggtagatctaagtatggtgtatttacatatgtgtatatatacatgtatatatacacacatatattttcagtaaatgtgtgttttacatttactgaaaaggttccctgatgttcagctctgccaccttctcatgaaggggttccctatatttgtataatcttatctctgattctctagttggctccactagctattcattgctccagggcaaatattcttgtctgaactactgtagttttgtcctaggcgtttgctccttattagtgcaactcctgtaggtatttttcttcaataaaattgccttgcagaggttgcagtgttcagacatagcgccattgcactccagcctgggcgacagacatgtatctgtatctaatcatatatctttatctcatatatatatatatataatatatatatttaagagggcaaaaatatgcagcagtatttccaaatatttagtgcttgtagtttttctcttaatttttattcatgccttggaaatgttggctgtaaaatttagatgaatcttagcaatgctcgatttttacaggaccctaattatctttgtttattttatttagttgttttctactttcttttccctctttcagttattattgacaccatgatttataaaacacagtttaagcaattttaaatcctcttggattgtttctatgtttttaaagagaattaagcctgtatgttttcctaatgagtaacttgtattcggcagaaatcctcaagaaatagtcaagtaacataaagagatcacaataataattaaatataaaagcagacagcaatacaaaaatatttaacacaattgtaaatatttatatttttataaagacttgttatttgtaagcaaatcaatttgtacattcacctgtagttaggaattagttttatcgtccacataaaattgaaaatattactatgaaaccaataaagtgtctttcagtggaaatgatcaattgtcttatagtgcccctttcctagttaaatataggttaactaacacttgttggtttagacaacgaatgtttaattcctacataattttttataagaacatatgtaagtatttcagcatttgtctgtaatatcagaactgtgtcatgtttgagtcatagtgaataccaccacaatgctcttttcaagtactggaggatttctaggcttatgtaattacttccgttcatgtcctgattattgtttactgtcagaatcactccgaagaggtttatgagaaatgcggctcccatccccggtcatcccatttcctaaaaacaacccactcatcactatgaattgctgttgtgttctaaaatattatggctactattctacataaggaccattgtttacacaggccatatctgtaacctcttgaaacttttaaaattgtatttccatggaaaatatatttcaatttttttatataaaggagaaaaataaaaaaaacaaagtacatctaaaaatcaacttacatttgcaataaaaactttttaaaaattaagaataaaaggaaactttctgaatctgataatgaatgcttttaagccttgacagtaattatatttaattgtgaagagttaaaacttttcctctgcaataataaaaagaaaaaaatgtttttctgtcactattatttttttcggcattgtactgaacttcctagacaatgcaatgaggcaataccatgcagttataacgcatttatagacaggtagataaataaatattggaaaagaataaataaaactaaataattaaagttaataatattttctgctagaaactcaaaatatgcatatagttacagaaaaacattaaattcataaatttagcaagtcaacagggacacaaatgttatataaaagtgcattttttaatatatgaatatatatatgtatatactctggcatatatatattcatgaaacctattttagttaaatatataatatatatgaaaagaaataaaatattcaggaatatctaaacaaaaactgtaacctctgcaaaacaactaaagataaattaatgatataagtaaatagatgaaaatactggatttaggaattagatgactacttaaaaataaaaaaatacacagcttaaaagctagctcaatcaaaatcctagtggactgtataaatggttaacttggaaagacaattaaaaaataagtaaaatttgtatggaaaaacaaggaccaagtatggtccaggcattttttgtttgtttgtttcttttgttttgtttttgtttttttgagaggaagtctcactctgtcgcccaggttggagtgcaatggcgtggtctctgaacactgcaacttccgcaaggcaattttattgaagaagaatacctacagtagttgcactaataacgagcaaacgcctaggacaaaactacagtagttcagacaataatatttgccctggagcaatgaatagctggtagagccaactagagaatcagagataagattacacaaatttagagaaccccttcaccagaaggtggcagagctgaacatcagggaaacttttcagtaaattctgcaaggtcagcttgatatctccatttatctgtccatctatctaacaccaattttgtgatataaaatttggcacctgctttacacctttcacaaatatcagcttaaaacagactgtagatccaaatgtgaaaggtaaataataagaaaaataagaatataaatattagaacaataaaactttcagaaaaaaagaaaaatagagggggaaaagcaaaaatttcagaatcagggcaaatatatgtatataatatttatggaaaacatatatttagtcctggggaatttgatatttttctcaaagcccaaatctctttttcaatttgttaaacatattttttattactcttcccagcctggattggttgttcttactctactgaagaagggtagcatatttagggtgcattatctgataagaacatgaagcatggtacaggtcatatatacctaacctctttagtctctcttcattcatttgatgaacattttattatgatagcattaatacttgcaaagtgggtcttactccattggtggatcaaaaattaaattctacattttatactggaaataggtatttctaacaaaagacaaataatatatatgaacattaataaaatcttttttagagaagattttaacattaaatatagcaccagaagaatattcttcataagtatttacatcatttaatgagtttcttagtttaactattttatcatacagtgcctttgggttatcccttgtcctctttcagatttaactatatcttaagagaagtctatttattgctcatttgtctgacagactgtttctcacactccatggaagaagctacaagtacaaagtaaatgtttgaaaaattcactctggcttattttaatgacttaataatagtcattttgtaaaacagaaaatctgggacaaatgcttctaggacatgatgacagaaacatagaagtaaagcagaactgtcctgggtaaaactgaagatctggtcactcaatctaccttaaaacaacagtgacaatataaagtggccaccaggatagcacacaaaatgaaaataacgtagcacgagttgtgtatattgaattgccacagccttaagtcctattattccctgcaatacaccatccagtaagcagaattgggtaactaccaaatgatgggaactctgaaaagtttaaattaatgagatccttgaaatcaaattagcaaggaatgtaaacagagagtgaaaaaatgctttttgggggaccgaagggtccaaagttcagcatgcatacctgagtggggtcactgtggctggatcagaggtgccagtggtatttggaaatgcaaagaatcaaaatgacttgtagtttgtatccattctaagtgaacaaaagtgtgcttagaaaaaaaaattctcttagaatcatactttaattagagtagcttatcagttcacttattctgataataaacatacaaatataattactaatgtaatcttgggttccattattgtgtggacagttgacattgtttgcattactctggagagacttttcataattgcaaatttaaaatattaattatgtctttctagctagtttccaaatcttggcaacttttcatagcaaaaggtctttataaaaataagttcaacacaatatttgactttgcttattttatcaatcacattctttgcagaaacttattgtaacataggtcagtggtccttaacttctttggcaccagggaccagtttcgtggaagacaatttttccatggtcagggtggggagtgggcatggggatggtctggggatgattaaagcgcattacagttattgtgcactttatttctactattactacattgtaatatataataaaataactacacaactcaccataatgaggaatcagtgggagccctgagcttggtttcctgcaactagatagtcccacctggcagtgatgggagacagtgacagattattaagcattagattttcataaggaacatgcaacctagattcctcacatgtgcagttcacaatagggtttgcaatcctatgaaaatctaatcccgccactgatctgacaggaggcggagctcaggtggtaatgcaaaccatgaggagcggctgtaaatacaaatgaggcttagctcttttgcctgctgctcacctcctgctgtgcagcccggttcctaagaggccacagacaagcaccagtctgtggcctggttgttgggaacccctgacataggtgacacaggatgtacacttgtaccacgtgcttgaaaggaaaacgttagtttggtcatctctggaaattgcatttactgatatatttttcatttttatgacagaaaattttagtgtgataatagtatcttaacagaagataatatatttgttgtgtgtgtgaaatgaagcattcttgtaatgtttaaaggtgctaacctgtataaaactacatagaaattttaaagattgagagcattaatgaaagcatcaataataatttatccaaacatcagatgtattctgccatcactgagtaaaacctgaggtaaaggtagtgtaactctgtctctgttgagttatgtaaattttattattaaccaggagttatgcagaggatgaaactattctcatgcagatgtttaacatggcttacaactttattaaatgatgttctttcctgtgtcacatagaatgctttatccactggtgattatgggaagcatataaacaaaaaatcataaaaagtgaaaaattttcctatgcagactaatttagatattatgtaagcaatagagaaattagcaacctgtggcgagggcattttataattaaagcttacatttattatggaatactaaagtacaggtgccacagtatgctatagtgtttgaatgccaagattccagctgtagatttcaaaatgacatttactttagaatgttatattttattcattttgaattcaatagtaaggagattaactgttcttttcttacaatgtagatataaatttaatggaaaagctatttttacatccagttttagtacaagtatactttgattaatctgaaacaaatttattgagatgttgggttgtataattgtcaacttcaatgttatacagatcaaataatattatagtgatccacactctgcatatgtaatttctgcaacaataaaacaggattaagatgaatgaggtgatcaaatgatcaaatacatgacataagagttgtataggtatatctgctcactccttcacattgggaacttattttattagtacaaggataattatttttctaccagtactgactgacccattcttgctgcatttatacttgagctgcaattactctacaacctaaagtctcgaagtgaaactcaggaaacagataatattttctcacttgtcatcttaactgggcaaagtgttcttcaaattttttatttttctgtccatagtcacctaaaaactaggtcatttttattatttttgtgctgcatttttgacacctctactttttataatctgagataatggaatttaagtaaaacaaattagactgtgtttaataaatcaaacaatattatatttagaagaataagaagagaaattcatcccagtctcagtcatgttcaactcatgttcccaaaggcaagagatttatagaatctaattcacaaatgtgataaattttgaaaattcatgattttttattttcctgagtattaactgaaattaaatttgtatagattttccatacaaagcttaaggtgaatttaatatttctataaaagctctcctttatgacatattgtaccatattgttgatgaagaatattaaattttctatatgcttttccaaaaaatgcaacttaaaatattgcataataattacagagatcattataacatattatatttgaatttaaaatctgaaatgccaaaataagcttccttaaatagtaaggtaaacagagtcttactcactagttatccccattcattttcaaaagcatctggttttgaaaataaaaggaaatggttattgcaagtggaaggaatgttggacacttgataatattaaaaatgatgccctcagtgactacagatatgaaaaatttggtggaggatatttatttggaaaagctccaaagagagtggatagtctttttactagacaatatattctccttgcttttattaggcagaaatatgtgaaactaaattttaaggaagtcagattttaaattttccttttgcatttgcacatacacagacatataaacaaagtctattaacactaatgatcattcataatgtgtacaatatcaatatctatttattatggttgttttccacgtaatgtgactggctaaagcatgtttcacttttagcaggattttgtgctgatttgcagaagataagttacccgactctgctttggtttaattgcttattaagtagtatactacacgtattttaaatgccccttcttttttttttttttgacattataaggttttaggtaaaactagcaaatattactgaaatggaagattacatatttgataggctggctattcagatacaatttcagaatgatttccatgaatttcacatctcccgaaatcttctatttatatcctaaactattctaatcacttatttagcatttttttgtccacccatgtactcactcatttatttattcaatccttccaaatctcagtcactctatgacttgtggtctaataaatcttatatttttggatggcagaaaaatagtaactttgcaaatccaaagtgacaattgggaaagcataatgttttatctcaactctacttgaaagttctagtttgaagttaatttcatttcaaacataaatgcagtcagtaaaagcccatcattacttgtaaagaaatgtgtgtttaataagcaacaagttaataattttcttgattttatctcatgacataatgaaatatggattcccttcagtaattcaaaccaaattctgagttcaagtgcagattcaaatataataataggcagttcacttcaatacaacagaaatatatgtaagaaaaagaaacagcaaaatgtttgcaatagttgtttttgaagaataaagtagctggctaggaaatttggaagtaaggtcaatattcaaaaacttaaatggccgtggatatagaaagataatgaagaattgaagttatatttaggtaataaaacccgcagtattcattaatttaatactgagattgaggaaaaaagataaatcacatataattttattaattgatttatttacttcacagtcaacacaaatgcaggaatgcttcagaaggaaaccgttgctagaagtttggcaaagcaatagaaatattcccctatttccatattatataacacttctaatagcaactgaccatcactcagctggcctctccctctcatggaaaggttacacaaagtgctcattagttcttgcatgatttcatacaaagcctggaccctaactggcactcacacagtatgtattgattacacaaattgaaaagataatttgtacctctatctcaaattgcaatgcacaaagagatttgtgcttgctagatattgcacagaccaaaccatcttttgcaatctctctgaacatctacagtggggctgcactgataccatgataccaataattctctcatgggttcactacccaactctgtaaaatggcagtattgtacctcctcttctctaaaattttacccatgctctctcaattactgccttcgcattatgcttcactgacaaaatagaaacgtttattaactgattggttatgaacaaatatgttaacatataatctgtcccttctataagtacaatggattccatgaccctttctttttttttttttttttcaagaacagtgttttagaagttatgtccttttactttgcttcaaataatattattctctggaatcattccccatagtatataacagtgctgttcaatttcctttcttaaaaaacaattgaatagtcataaacaagcaaaaagtcctcttgaccttcatctttttctacctagcatctcacatttcattttctccctgtggcgtaacaccttttagacttggcttaaatcattattacttcctcttattcttccttttatgccatacaatagtcttcagtgtgctgtaatagcacaaattaaactgttgtacttatcaaaaaaccaggggtcttcaacttaccaaatcaaaagtcaccactctgtcttaatcttagcctcacagcagcattacacacggttgagggatttcttcttttggaacatcttttctcatatttttcccttcttcctacaacgcttgccaatcccactcattctaatttgccagccgactgctttttgcttaacagtcaagtcagcctggatgcttttctcttctccagctacgttctctgccaaagggatctcattcattgccatgcctgacatacgtgttatatgttgatgacttccatattgatgtatacagccctgagcactctgctatggattcttttttcctagaatgtggtatggatggcctctttgtataattcacctcaaatatcacctcctaaaatgtcccgtttcctccagacaattaataatcatcatacctcacccatacataacacttttatactatacatgatcatatattacctcctttaattaaaataactatttcttatttgtatataactaaaatgtgtttcatattagcaggtaactcctttatctcctttacaattttatctatagtttcaaaggaagattcctagcatgttacatcataatatatgcaagaagaagaagaagcagtggcagaggaagaaaagcaagaagcagagggaggaaggaggaagagagggaataaggagacagaggggagggcagtaagggaaaggagtagaaggtggagaagggggaggaggagagggagggatgaggaaggtgaactgtttctttgcctacctaccaaaatagagtaatttaaagtgctatttacatctcataataatttgtcttgatatatattacacaggcaaatttgtttctgctgtatttaaagacctatgttccaaacaatgtagaaatacatctttaaattcctacctggaatgttaaaaatcaagaatcagaaaattatatgatgaaatatgtatttttggaatcattggctaatgaatcaagtaatgaggtaaagtagttataagcatgttaccgtaatttaaaatggccattatcaagtcacatttatttgtcactgttaagtaaatttttgaattaaactttccagtatattgtgctacaaaaattttttgagtgaataactgagagaagttgtgcataatcacaatttcccctttactggaaagacatttctaatttccaagacagtcaattcttatatcttatggaaaccattctctcctaaatgcattatatttaaaatattaacaacaacaacactgggttttgaaaagtatctttgaataaacacagccacacacaggtgttcaaccacttagttttgtcttagtggttttttcttcatgattttgatgtatacaatagagtctaataaattcacttttcctatttttatgcatatcttgcaggattatcttatttgcttttatgagatacaaaaatatattttgttttgaaaaagaaattcttgtacttaagaacctagtaaatgaacaaggtctaaaaacttacgaattgctcaaataaacatatctaaacttcttttattcctgtgaaggctgagatattttaataacattaatatgtagtacccttttctcaaaattttgatgcatagtctaatttttcaaatattttacttaaacatatttgtagaaggaagttctagtatagacccttaaatcatctacttccaaaacatatccttcaaattttaaacctgcttcattgttaatatatctttgatgtaaattaatatgcaataccttctggagacatctctggtacaatggcctcataaggttcatctaggaattttggttcattgtcattgatatccgaaactttgatgacaaactcagactcaggttccacagcccttccagtagcgatgtctattacctgggctcttaagatgtagagggatcgctcctctctatcaagcttctgtatggcatatatgtcacctgttctttcatcaatgataaaagtacttccagctccagctcccaaaagcttgtactggaaagaattgtttccattgtctaaatcagatcttagctgcaaatggaaagagggatcatttagtttccaaacatctgaaatggacaaatcaaaatcaagattttctttttatgtatgttaattattccccaagttaatgattttatattatttccacattacattaaatgaggcaaaatattaatatcaagattaaaatctatcaccagggagaaggaagagtgaatatttagtgtaaagaactatacacatttcattattctaaacagaaacaaaaataattggataataaagcttcttttgtaagttatgcacaacatagttggttcagtttttatttataattaaattctcagtcactaaaactatactctcaaatatttatactagattgggtccttgagatagatagaaagacaatttagtgacatttaaacactgatgttctatctcttgcatgaatatacatggaaacaagaaaatattaggatgaaaattagggttcataaagataatgataatcttgactgttcattaggtatttattacatgtcataaaatctataaattgctttatattagtgttctcaagtaattctcatatcaatattatgaaatacatattattgatatgatcaatttttctatagagaagaaaagtgagattttgttttacaaacttttttcagagtcatatggtctttgtgtagatatagaatttacaccacgaggctatcaaatcttctatgaggctgtcaaatttcagactgtccactgacaacaactcagttacatcttctttagcccttgggttttagccataaagtataaaactttcttctcaatatattctacctaattctcaaatacacactttcagcctgtgcactcattttcatattttcaaaaagcaaagtaaattagttcatcattcatactgttgaggtattatttagaatttttaatttatctgtaaaaaaacccgtctaattctgatatagttaaaatgatcacatagcttttcatatcagaattatttgtatgtaagagaagaatgtcatggttccctaatcattgtgaatccacattttcttgattcaccatttatgaaaatgctcttattcacagtaagagttcctctgaaaatttacaaagataatcatgaaatcagttgtaaacaaattcatgatttttctgatggcttaagttataatttcttatactggataaattaatacactttctttgcggttgtggagaaaatctgaaggtactagtaactaattttgcattttaataacatgccgaatatcaatgctatgtaatgaaaaataacatccagattgtctttctggtaatacttcttttgatagttcttaattattcctaaaagaaattcttcatgcgatgatgtaagaaattgaggaacaaattatacaatcaaatcaatatatcaagtgagcaatgtatggttcatatttttaaattatatcatttcaatatgatttgataatttatttgatattataatgaagataaattaagtttagtaataagtaaatatattgcaagtatatgtgcagtgtaattttcaaagacaagtaagcttgacatttttaagacccagatttaagggaagacagaaacaaaaacgaaaaagcttacttgaacaccagccttttaatgtcataaaatgcatatgttaaacacatttcaatcaaatggcctgtagtattatacaattttctatatttttattcaaaaaatattttcctaattaggctgctactatcaatttgctaaacaaatatcacttcaaattttcacttaattgtacttcccaatcttaatcatttttcaaacaaatggatcaaagagagttatcttgaacgcagcagctaaattgtatatttactaactcttttgacaagcacctaaacattcattattgttctttttgaaatcagtgattcacttgttttttaagcctgatgagtttgtgtagcagaaaaacatttttcagagtagtttcataaatatgtctctgaaatgaaaaaataggcaaaaccaatcactgtgagaaaggaggtaaacagagattcatgtggggagtagaaacaaacaaactagaaaatgtgacagccccagaggtggcctgtgttccaattacactgatgcacttccctataacaccttatttactaaaagccaatagctgattttagcctgtcaccccattcagtgatgggagagtatatggtgttctgtgcagtccactgtaaaggtagctagagactcagttactgagtcggcacctaactgtggaccttcttagtgccaactgtgcgtattatttacctgtagtctgagtcgaaaataaaaggggttgagaaatatttcttgtaatgtgtgtgtgtgtgtatgcgtgtgtgtgtgtgttcacaatacaccctcctccctgcacgtttggaaatacttgcctaaaatcctaatctaaggctttggttgaatgtactcatatacatttggctgataacacaggtgaagttctatggaatccagataccatgctaacactgcagctctcctgaaagggctagaaaatgagagttaataaattttgagtgcttcaccctttgggcccaattaaattttagtgccagttaattagcggttaaacttatttcagttcatttatctagagaaaaagccttatggaaaaggacatgatattgtaatcacctttgtttaaagaaaaccaaataataaaatacaagccaaaaacataaataggagatgctttgtctcattaaggaattgttcttaaaatatattcttttaagaaagtgaacataattattccttttactttaactttactaatcaatttaagtgtgtaggctcctgaagctacttaactgtaggagaatatggtattaacctgcttcattaaaaatgaacgaggggtaaatcaacagctacttagcgtaacagaaaatcgggctaaatactgttggtaaatgatatttgtctcactgtgactgcttagattcattaccaaaaataacgcaataaagtttccagatgttgaaaatgagggctgcattttcatacgggatactgaagtgaaatttaaaaaccagagctatccctcttcaagattttagtggatgttttaggtgcttgcaaatctgaaacaattattgatgctgctgtttgaagcttttcaatggcttcactgtaaaaatgtggaactcatcaaatctccaaacttctccaacatatttatttacattgttgtgctatttactgtaacattttaaataaataagtacctggccgatgtgatgactagtcgtattcatttcctctggtacaaaaaattggttccacacccagccacgcttcactctcaaatgagatcgcactggctgcttgactttctttgtttgagagttttctgttgctccaagacaaggccataggagaggaattcccaacataaaacgcagcagtaaataacagttcattgcgttgactcttttgattccaactattactcttcagaggaaacaggacgtcactaacaaaaatcttgctttcttttataatcttttctgattctgtgtaccttctatatacctaaagcgtcagaaacaaaacaaaatttgacattttaaaataacattttctcacataattactaaagacaggttacaacttctgcatctgacaaaagtggaataaaaataaacatttaatttatcttccaattaagctggctaattatgatttgtagctcagcaataatttgattagaataattataaatttccactcaggcactgctagttttaaactgcagtcataaatctgcctgaaagttgaaagattgctctgggagtctcctggattgacagctgacattgagatagacttccttttaatttgacttgcttactttctccattctttctcagtaaaatacaaactatctcattaaagcaacagtcaatccaggaggaaaaaagtcttatttttcctttttatatttgatagagataagcttcctcatccaatttcccaaattatggtattttatgtagtaattaaatagacaaaatgacaattcagcttaaaactggtgaattcaataatcagttacactgatactataaaacactgaatagaaagcttgcataagatatttactcttttttaatttcaaagatatggggaagaagtgtttatcagcttaacaaaaacaaaatcctcttaggacaataaatacaaaatgattgttcctgggtaagaatgggtgaatgtttgtaatatgtaagaatgatatgaaatgtatcttctagtatttaaatattaaaacaaaagactctggctattgagttttacatttaaaactttccattgacccaaggctctctcttcatgatgggtacctctaatccttatatgtaacttaatagttttgcatttccaacatctacatccagccaaatttgatttattttatgaagaaaaataattttgtaagattcacaatggagtttaatgtcatataatcaacagaaaagccagagttcatgttaggactttttctacatgattgtgttttgaatcttctgcatgtatttttgaatgactccttagagattttttaggtctttggctcgtgttaagaggagttgttaaaaaacacctaattaagaaagtacacagggattctgtggtcccggtatactccctttaagcagatgtattccttgttaaaagtttacttaatgaaggtcatagagaaattcaactgaggtgaaatttatctttatgttacgtatttgaaattcagataaatctgctctttagaaattgctaaaatatatatttttggtagctgatgaataaaaatatttggaactggtacaatattattcatgaaaaagattttttttataagtttggcaaattattaccaacactgatatgaagttagctggctgtgtttcagtgaatataatttttgggaactttatattatggtattttgatacatataaagataaataaaatagtgtaatgaacacctggatatcattaccctgtttcagtaattaccaacacatggtcaatattgtgtcatttctacacgtgctcactttttaatattaaaaccaatttcaaattcatatcattttaaccactgaagccacacacacacacacacacacacacacacaagtatacatgttatgtaagtgtgtatacacacttttaaacatcaaagcttaaaattaagaaaaaattttaatataataaaatattcatacagtgttcaaattaaaaatctttatctttgaattaagatttaaatatgtccacacaatgcagttttttggtacatttctcaattctcatttggtctacaggtttcctccaatttttctttccgtttatatgctgaagagtcaaggttatttgtcctacagagtttcacatagtctgaatgttgctaattgtatcactgttgtgtgattcagtatgtttctttatcctccatattttttataaatgtttaggggcttgattagaagtaatataaaatattcatcaaaaatattcatagccaatcctattgcatgacatctttagtagactaggacacaaaatatatgttcaagagaccagaagaaatgttgaacgtgttaagcagaaaaattgaaaaaataaaataaagattaaacttttagagaataatactacaatgtctgtgatgaaatacactgcatatgattaatggcatattattcacactgagaaaaaaaaacagttaaactgaagacaaatataaatcttctgaaaaaacataatgagaaacaagttaaaaaattaaaaatgaacaaactatcattgagttgtgagacaatttcaaacattctcatttatgtataactgcagtttctagaaccaatgaaatttagaaactcatacatccaaaatgtttaacaaaacttaagcacaggtgttaaaaaatattataccaaggagcatcatgattaaattactcaaaaccattaataatgagaaaatctgaaaggtagacaacgatatgttatatatagaataacaaagataaagttgttagcagatgtctcatctcaaacaatgcatgccaaatgacactgcagaaacatttttaaagtattgaaaatgaaaagaaattaatccaactgagaatttctcaaccaatcacaatgatttttgtaaagagatcagctgaattgaaagagaagaaactgagctgtcaggtattggaacagctaatccaaagaacatgtaaaaaaattaagaggtaagcctttagacacttagtgcaatagtataagcaagaggctaaaacaaaagaaattgttgcatctccttttttcatttcctccatggaacagcactctaattcagaggataagcacagacctgtggatcatttcattataatggtagtgctacaaaaaactaagtcattttttatggactctggggtcgggggagtgcaaggggagtgttaagagtgaaaaagtactaagtacattgtcagagtgggaaactgtcttcaaggtttcacccactttactcaataaggagacctcatcagaaatgctggagaaagacctctgcccaaggccacagataaagccctctttacactttaacactggggctagtaatgcaaatatgagaagagcatgacctaacagaagggactgtgtccttgactgcaactcccttcagagaatgcaatgcactggttgtgcatcaaatctggtgtgacaagggaatgttttcgcagtgactactgtactgccaggtcaagtctttatagctgcctatcaccaggcctgaacaaatcacagttgttacaccaaagccgtattcctaatcttcaataaaggaaagtgggatgaagactctttctggtgtacagcatcagcacacaaggggaactacaatacgatacatgattaaatgagtccttcaagaagaaataaaataatactagaaggaaatctggatctatgcaaaaatagaatcaccagaaatggaaggtatatcagtaaatagaaagaccttctttaaattataatatcattaaaggagaattggctgttaaagcaaaaataataacaaagtattgtggagcatacatcatttacagaagtaaaatgtatgaaattaacagcataaagattaggaatatgctattttaagctccataaaccatatataaagtggtatgatataacttaaaatagattataataatggtacatgcgcatataataaacctaaagcaactactaaaataaaataacagagtttactacaggctacaaaatagataaaactgaagcctaaagaatactcaatctaaagaaaaaataaaagaaaaaagtgagcaaaggacaggtgaaaaaaacatacaagtagcaaagcagtatgtttaatattaaccataataataatcactctaaatattaatgggataaaaaaatcaaagtatgagatgaggattattagatttttaaaaagactcaactatatgtctttaaaatgatttaaaatataaaggtacagtaggtaagaatttaaagaatgaaaaacatatatcttgctcaactctagtcaaaagaaagctacaatggccataatattagataatgtagattttgggacaaagaatattagcagtgataaataatatcatttcataattataaatttcataattataagtgataaacatatcatttcataattataaatgataaacaatgtcatttcataatataaaacaatatcatttcataagaattatgtcaattcattaacagggcacaacttttctaaatgtttatacacttaataacaatgcctcaaaataaatgaaatacaagatgaaataaaaccttattgtattacaagaagaaacacacaaatctataattcaaattgattcatttctattcaacattatactgaaaattctatccaatgaaataagaaatgagaagcatctagattaaaaagataaaaatatgtttatttacacagggcataaatacacatatagaaaatcttatgaaatctataaaaatactggtaaaatctataggtaactttagcagggttggaggatacacggtcaatattaaaatcaattatatttctatttactagcaacgcataagcaaaatttaaaatttatacaacagtacattttataataatataaataattcaaagattgggacataaatctaacaaaaatgtgcaatacctctctattgcacactataaaatactgctaagaggaatcaagaaaaatcaatatgattggagatatttatgatgatactggatcagaaaactcaaaatggttaaaaatgtcaattccctccaaagtgttgtataaatgcaattttaaaaatacaattaaattaaaattaaaatacaaaataaaattccaaacaggtatttttataaaacttacatgctcattctataattatatatgcaaaagcatggggcttagaataactcaaagaacattttaaaagaagaggaaatttggaagactatgccatctgactttaacacataatgctacagtaatcattatggtaaagtattggatcaacaaataatttagtagaacaaaccacaaagtgtacaaatacacctacatttatgtgatcaattgatttttgaaaaagttcaaaaggtgaatcaatggagaaataacagtctttgtgctaaaacacctgagtattcacttgagaaaaagatactttcatccatactttaccgtgcatgaggtcacaaaaagtgaatacaaatttagatgaaatacttgtaatttctttggcaaagatttcttacaacaatatcaaagtgcacttgttaaaaactgttaaattggaccatatcaaaatggagataatctctgtatcagatcccattgctactgtaaagaattcccacaactcagtgtcttaaaatgatacacatttattgtcttacagttctataggtgagatgtttaaaatgaatttcactggactgaaaccagggtgccagaaaggtcatgcttccacccaagtctctagaggagagtctatttccttacattttccagcttctcaaagtgtattctattccttgcatgccttggttcatattccacctctaggccagcagcagagcatcttcaaatttctctctactctatcttcacattggcttctctttgttgtgttaaatttacctcttctccctttataacgacacttataatttcctttaaagtccacttggataatacaggataatcttcctacctaaagaccattaactgaatctcatgtttatctacagagatcacagtctttggttttaggtgtgaagaccttgatatctctgcgagccattatgtggtctacctcagatgataattacatgaggaaacaagtcacagactgagcgaatatttgttaattatatatcttgtattcagagtgtacaaggactttcaaaacttggaaacagagattcatcacaatttttttaaatacgcaaaatatttaaagagacatatcacaaagagttgacatgtaaaataagttaaaaaatgataatcaacaccttcagtttcaacgggtaaatgcaaattaaaactacaatgagataccagtaaactcttactagaacgaatataattaaaagactgaccttatcaagtactgaagagaacatagagcaactgtacctctcatacactgctagtgtgaatgtaaaatcgcatgactatttagaaaacagttctgcaatttgttaaaaagttaaacatatacctaccatatgatccagccattctagatattagctagatatcaaggatatctatctagatatctacctaagacaaaataaaattatatttccatatgaagatgcttacatgaatatcagagcaggtttatttgtaacagaaagaaactgggaaaagtcaaatgtctatcaacaagtcaatgtactaagaaagtgtaatatgtctatgcaatgtaatgatactcagtagtgaaaagaaatgaactactgatacagtaatatccaaaataataatgagtaaaacaagcctgccaacaaattcaggttgtgtgtttccttttgcatctaattttagaaaatttaaaacaatcatagtgactgaaatcagactaagaactgtgggaaaatgggggtgggaggaagatcaggagggaaggatgatgaagggacatgaggagacttttgagggcagtgatgattgtgctcattatctgtattgtgatgaaagtcttagaagtagaaatatgtcaaaaattcaattcaacttgagtatatgcagattattgtgccaattatacttcattaatgttgttaaaaatcttgacttgtcaaaacctagaaaaacaaattagacaactaaccgtggaacaacagataatagatgtttctgatgtgttatgatatgacctttataaagaacattgcctataaagtattttaccaaaaaaagttgaaagctaattttcaagttatgggaaattaacctgtaataaaagaacaaattaaacaggaaacaaagtaaacaaagtaaaaggaaacaatcaaacaaacccaaattgtgtctttctacagatttgctacccacagtgtaatctgtggaatagcagcatcttactacagatgcgaaatcttgagcttcttcacagataccgactttgagtctgcattttatcacactcaccacaaggtctgaatatacaataaattttaaaaaagcattgatctaccacaaaattgatctagtttatttgacatgtcaaaaaaagcaggagtataggaaagatattgctctagattaagaaagatttaagatatactagaactagtgtaaaatgtgggcattgtttgggtcatgactttacaaaactgtttttatatttgcatttttatggatttataaaaaatttagtctgtataaggtataatacatactaatgtagagatgagcaatagatgataatgagaaagtattgccagtttttttggtcattgaatgtttctttcttgttatataaaaacacgccctatttttagtcgtgtatacttgaagcatattggtattagaaatgacagggtgtcttgagaaaaagtatattttctttaaaatatctcaaaaaaatggaagataggcaaaaccattgtggtaaattgataataattgttgagttcgggtcacgagtatttggatagttgttcttttattattcacttatgcttaaaatatacgtattaaatcaacaacaaaaatatacagcaattcgtacttttaaatcaatatgttaaacaaatacaagtaattactgtaataccagctattgatgacaatgtatagaaagcagaactatacaacactcataaaatggaaaatttggacactattttggagaataatttggccaaaagcaataaattttacaatgtgtatataaagtagcagttgtattttactattttatacctagagaaatattcaaatttttccactgggaagcaagtataaattggattaattgaaaaaagaatgtttaaattaggataccatatgataataattatataagtgtttcacaattacaaggcaatgtcccataatactcttggcataaagcaattagttaagttagtaagtctaggcagagaaaactgacaaaatttgtcatggtaattacaatgattgaaataagtgaaatttgtctaaaagttgaaacttagaagtttctgcaagattctccttcctcgaaaacagtttaaagtaaatatgacaaacaacaacactcatgacatctgggtcatttttctaccaagtgctatttttccctattaaatatatgattgaaatatttctcaattcaatttaaagttaaaaatcatcatttataattctaaggaaaaagccctttaatttgaacactcttagataaaacattcaagaaaaatgaatggtagcagtaggtatatctcaataatgaaatactgtggctttgtttatactcctctatattccaaactttctataatggtcatacatttcagcagaagtgaaaaacatttcacataatgctccacttctgattgaagactggtggcagctgtcagcattgctagactgagaaacactctgggctgaaaccaggcaaataagaaaaaatgctctcgcctgaaatgggccctggataaaccagcagtggcattttgccctgcatttccaatcttgtttatattttccaatcagatgaatatgctaaaaaatctacctaacatttcagtatgaagaaatgctaatactatgtcttatgttagtgtgtttttatattttctcttattgctaatacctgggaatgttaatccatatttattttcaaagttgtaaatatatttcaaaataaaagtgcacttatattagcacaatattagatactaaactaattataatcatatttaaatagcattattataagaagaaacaacatattatggccaagtaaaattgcgagtatgtttgtgatgattaatattaggtgtcaacttgattggattgaagaatccctagatagctggttaagtattttttcttggtgtgtctgtgagggttttgccagaggagattaacattagagtcagtgaactgggagaagagtcaccctggttgtggttgggcaccatccagtcacagctgccagcatggctagaacaaagcaggtggaagaaggtgggagaaactggcttgctgagtcttctggctttcatcttcctcctgtgctggatgcttcctgtccttggatatcagactttaggttcttcggcctttggactcaaagtggtttgctgggggcctctcaggcttttggccactgaaggctgcactgttggcctccccgcttttgagactttgggactcggattgagcgactactggcttcctacctcctcagcttgcagagggcctatctgggacttcaccttgtatccgtgtgagttaattctcctaataaactccctttcatatatgcatatatcatattagcattgcacctctaaagaaccctaatacaatattttatttaatgtgttaattacatcccatatgctaggacttatattcagtaattttaagtgacctgtcctgtaaacaaatgtattcataactactgatcttaaagacatcaagtgtattctatacactgtactttattgaatggaagaaaaaaatgcataaatatctaacactgtgacatctatatctaatggttcactttgtttacattgaataaagatctataaattacattttaacgtttggaccattcttcaaatgacaaaatatatgttttctattatctcttcttagtatataatttttccccttgttctaaagattcttgaggtcaagtaaaaaaaataagtcagaatgatggatttgatggctgtgtgggggaagacataagttgaagctgggaaatgtggatgggataaatttagaaacttaatcctgtttgtgatctcttaaaaaatcaagggaaacttggcagcttcacagaatgacaccatgcataaaaagactttgaaatggctttctcagaaccactagtatgaaatataaagaaatgtgagtggatacagtttgcatacataagtgaaaaggaagcaatattttggggccaaaaattttaataacccatgtgtcaactctttctctaaacattcattgcacagcactaaaatgtgaaagatcattttctgttttatttatgaactctcattaagcatataatttgcatacttactgtcaccaaaaaaaaaaaaaaaaaaaaaaagccctctgggacagctacagcagtgtgagtcagaatagctatactggagcctctgatgccctctttgacattacacagccttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatagattccaattggttaaataaatgctggtgaaatttcatattcttagatacagtatttcactttttattcccctccacaaactatcagaccatgatttgcccttatttgtcaagggtaaatttttgtatgctcctgtattgaagatttgcctaaaacacctttatcagtatagatcttaattatgtctttaccatctttgcagtctgattttttaaaattattgtacttttttatgagcctttggtgctctcagtgttatacaaaaataaacatcagacatataagcattgataattatattctttgtttaaaaaacatagtgacaggaatagaatgaaatgaagggcatctgaaatttatagggttcgtgtgagaaaaataggaataaaaacatgattttctttttttaacttttattttgtgtttggaggtacatttgcacgtttgttatataggaaaactcatgtcacaggagtttgttgtacagattatttcattactcaggtactacgcctagtacccaatagttgttttgttctgttcttatcccacctcccaccctctgccctcaggtagggcccagtgtctgtagttcccttatttatgttaatgagttttcaccatttagctcccacttataagtgaagacatgtgatatttggttgcctgttcctgagtgagtttgctaaggataatggcctccagctacatctatgttctcacaaatcacgtagaccaaggaaacagaatacagagcctagaagtaagactgcacacctacaatcatctaatctttgacaaaaacaagcaatggggagaagactctctattccataaatggtgttgggtaactggctagccatatacaaaagattgaaactggaccctttccttacaccacatacaaaaatcaattcaaaatggattaaagacttaaacatgaaacccaaaactataaaaaccctggaagacaatctaggcaataccattctgggcatagcaacaggcaaagattttatgacaaagacaccaaaagcgatcacaacaaaaggaaaaattgacaagtggaatctaactgctcttaagaatccctgcacagcaaaataaactattaacagactaaacaggaaaactacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcacatgacaaaaagctcagtctcacttattagaggaatgaaaatcaaaagtacgagataccatcttacaccactctgaatggctattatgaaaaactcaaaaataacagatgctggtaaggttgaagggaaaaagatacacttacactgtcggtgagagtataaattagtatttacattagttcatttatgtcatcattgtggaaagcagtaaggcaatttctcaaagagctgaaaacaggactaccattcaacccagcagtcccactactgggtatatacacaaatgaatacaaataattctatcataatgacacatgcattttcactcatgcacacatgaatatacataccataaaggtacacgaatgctcattgcagcactattcacaatagcaaagacatggaaccaacctcactgctctttagtgacagactggataagaaatgtggtacacatataccatgaaatattatgcagtctgattttaacttaaccatcacatgaacacaggctatttcttattactttcctgtgtgtttgcagtcaaacctgtacaatattttcatgtttttctaaaatgtgttttttctcttaatgttcttatgacaagatatactacagaaaaataaaacactgttttacttctaatatctaaacaggtattctactattcctttgattatttcagaagataaactcacataaacctgtctttatttttagttttcatgtacaattaaaaagcactgtaaacactctcaatagccaaaatccattcactgggaggaggtacataaaattggtctcacagttgaacaaacgaccaaccgttgaatacaaacattaaaaaatttatgtcaacatgttgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttcgggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatactgtccggcacgtattaagagttaaatgtttttagtgagctacatgaaaatagctattgacaggtgaataataagcatctagtgatttctgcatttctcaaggtcgaaatattcagctattttcatttctgctaaaaatatacacacataaaaagctttgtaaatgactattgcaaaaatactttagtatatattttccctgatgtatatgttccacatgtattttcaaattatttgaatgtcattattttttttctaagcatggttaagtgactatgacagatacatattatcatgcttgaagcaatacatgatattgcatggacatatataagctgaaaatgagcccagtgtgactcagaacaattatattttcaaagaagactaattacgacttaagggatgaaaaatattataatctatgcacttatgcagtttgaaactgaatctaattagaaattgtcttttctatgacctcttcttggttacataaagctaattattccatctgtgaaaacttgtaaaaatataatgtattccggaaagctcatggaaagctgaaatattgagctcaactaagcccagcttctcatagagaaaaacagatggcaattaatataatgtctccatttttagaaaaatattgagtaggcgtggccaaaatgatatatcatagacttagaatttgtggtgatcagagagttccaaacctttcccaaaacaaagaaaaacagaaaaacttaaaggttttgaaaatgctactaaaaaataagaataagagtttctcttcatcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatggagagttagtggcagattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacattttaattttattagttagttacaatatgattttagtcttaaaagaaattatttggatcttctaatcagtgcttagaagcacctgcattaccaggacattgaaataattgttctgtttctccatcaaacaccctagatccatgaccttctattgccttcttgaaggtgatatttcatcccagcactctgactaatcctgctcttcagcaaaggacaatataagtaagagaatcaataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaaattctgaatgactaatcggatgaaatggctatgactggtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgagtgactgtgaaacttggatacacttcccccactaacttccacctgatgtttgtggtaggaggttgctgagaaatggaaggttaattggttactgtaatagcctagctccccgactaacaaaatcaactgtgtctctaatgccataatggtactcatctgttctcttagtaatttgtctcataattcaatggtacagtaaatattatattcatttcaaaagagaagaaagatcaaggtgagcttgtacaacaactcctcaaaaaatgtcattttgttgaatttcatttcagtgtaatattgatgagaaaaaagttgattcactgccagagccactatctgtgttgagtctgcacattccccccatgtctgcatgggattatctggatcctccagtcacttcccacttcccaaagctgtgcacatcacgctggttgttcatctacaaggccccagtctgagtgagtgtgaccatgtgagggtgatcctgcaatgggatggcaccctgtctagggttggttcccaccaatctccctgggtttctgggataggctcctgtcacccatggccctgaactggaataaccaggttggaaaataaacgaatacaaattattgtaaaatgaagatttgtaaagtacatgatcatcatacaaatgcaggacaataaactatgctgggtaggaaagagttcagcgagccagctgttatttgttaattcttgtgtttgaacttcatagtggccagaggtgatcctgacaatctttgttttgccaacattcatttcttgatttaacccatcaccacaactgccagtcactcactgattcgcccaaaattgggtaaataatgatcttactcatttttactaatcatatatatctatatctatatctatatatatatagatacagctcagatttatttcagtgtttaatattagaaatgttttggtccttatttataagtttagtgaagtttttgttaccagaaatatgtcatagggactaaactctcctttatctcaattagcctctgataaaattggttttattacacagtgtttcacttaaagttacagtttgaagactgaagtggaatatatgcagatacaccactaaactactgattagggaatcatacatcccaggcttcttttgatgattaatgaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatacatatttgaatatatatacatatatatatatacacacatatatatatatatctgtaaaggcaacatgaaggattacatatttttcttcgaaccaacagtgtatttcattttcccaagaatttctaacagtatttatttctttgttcttatgctttcattaagaagatatagtttcactttgcacttgttgaaactctttttagccactgcttagtatagtaaataaaccattgtattcaatttgacagtttttgctgatgttgtgatagtagctacataatacctagacaaacatatcatccaaatgttcctttctccaattatcagttgtcctttcagcacatctctctataactgtaatatctataaatttactctactatcaaaaataatacttagtaagcaccactgccaaatggtatagaaagtactattttgttatggaaaagatataatataaacatgattttataaaacacaatccttcgtgaatggaaaaagaaaactaaagtcatgcactttgttaatttgcctttctttatgtatatatatgtttgtgttgtgtagaatcagtacaaaatctaaaaattaatataattatatcacagaaccacataaatctgattcacatgaactgagtgaaatataaaaatcatttgatccaggcctgcaaaagcactttatttgacaatagcagtaattatgactttaacaaatgaacaaatatgacaaaactattattattttgttagacctcattatatttagtttaaaattttattgtgaatgtggagaatacctcaatctttaaataaatatgtagacaaataagggttagtttgatccctcaatttcagggaaattgtttctacagaaacacagaatcatttcaaaagcttgacaaaacagataatcccactccacagctactgattcatgagctgggtattttttttaacaagcctcaaagatgactttacggtaaatattttcaggaaatatcatcaccatcatcatcttgtcaaccatactgagtgtttactctgtgatgattactatgcaaagataatggcattccttaattgacttgtcttacaataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaaagaaaatgcatgtagaagttggttaacacttatttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgataccatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataagataatcactggtaatcacccattgctacaagaatcatcaaaggagcagctctcaatataaatgctatttaagccatgcaggagagggctccttccaagtcagaacgattgaaaacgggaaatatttgctatgatcatttacaaatgattttaggtgtatacaccgaagattagtgtgcacagtttctattatgtaaaattttcagagttggcagtagacaacagtacaaatctatcataaatacttataaaaactaagagagtttagatagaattttaatttagcagaaggttaaaattcttaccttatattgtcactgtcacgtccgaatatagattttgaaaatcattgataatctagcaacttacaagtggaattctatttacctactttcctatttactttaatggaaaaaacattcctgaaaagtcatattggtatttgaggaaaattaaatcttggggttctattttgaagacattttttgcacattctggacataatatcttcagattatgtggcttcagtgagtatctgcctactgcatcacaaaacagtctaagcaatccatatttatctcttttctaatctccagacctacagaactactttccacgaggcatttcaaagtgcatactgaaattcttactttctattcactcttccacctaatcgttatgttccttctttcccttaatgaaatcagcatcctgttgaaagctcacacttgaataaaaggttcttctctaatgtttccttcagctaacctcccatatacatacatttgagcatgaagcctgactagagatgaactatgattaattctatgtcttaaatccctcaagtaaattcatttacctcctattacctccaagttcttaattcataataattttaaaatctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataactttatatctattaaacaatctttccccatttcctcttcttccattctttcctttctctaataatcataattcttcactctatttctgttagcttaattttattctagctttcaaataacagttagaacttgcagtgtttatctttctgtgcctgacctatttcacttaaagtaatgcagtccaggttcatccatgttgctgtgaatgatagaatttcattcttttctatggctgaatagtatttcattgtgtatatacaccacattttatttattcttttatttcttgatggacacttagttttcttccatatattggctattgtgaattgcaatacatatattgcaatacacattggaatgcagatatattttcaatatactgatgttctttcatttcaataaatacccagtagtgagattgctgaatcatatattacttctatctagttctatttttagtttttggagaaaccttcatactgttttacataatggctgtactattttaccttctcagcaacaatgaaggagttccattttctccacattcacaacagtatttttttttagactttttgataatggacattctaactggggtgaaataatatctcattgtgattttgatttgcatttccctgatgattagtgatgttgaaaatttttccatatacttattggccttagttcataaattcttgttataaattgtttataataacagcaaaataaataggaattgtatttttgaaagtaaccaataatgtttctggagtgttaaatactgaaagtcattttattttcaatctcacatctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacctcagggtatcaagaaagtagagttctacatcacattgtattaaaaaataaactagtgttaacagatgaacacaaaaatatatatattttctaatttgtcactgaaagagaccacaacataaagaataattctggttatttcttccactaatgtacaccataagtttccaattctgatcttttatatcggccttcaattaagaaaaattaataatttgctgtatagctgaagagaagttttaggagtgaatctcaggaaacagaaataatgaattgaagggtaactggaggttaagaatgaagttccacaattcaaagtagtctttcaaagaagttgctgagagagggaaaacagagagttgggatgatagcaatgagaggtttggagttaatgaggattttttagaagatagataatgtgctgaatgaaaatgggctaaatgccccactttttaaagacccaactgtgtgctgaattaaaaatatctgtttcatgtacaatgacacccacaggctcaaagtagaggaatggagaaagatctatgaagcaaacagaaaacaagaaagagcaggagctactattcttctttcagacaaaacagacaactatcaaaaacgacaaaaatcggcattacataatgataaagggttcaattcaacaagaagacttaattatactaaatatatatgcacccaacactggagaaccaagatttagaaaccaaggtattgaagacctacgaagaaacttagataaccacacaatcataattgggagactttaacaccccaatgacagtatcagacacactaatgagttagaaaactaataaagatattcagaacctaaacttgacactttaccaaatggaactaacagacaactacagagcagtccatcaaacaacggtagaatatacattcttcttatgtacgtatggcacatgctctaaaatcaaccacacacttggccataaagcaattctcaacatgttcaaaaagcccaaagtcatacgaatcacagtcttggaacacagtgcaataacaataaaaataaataacccaaatgtccaacaatgatacactggattaagaaaatgtggcacatatacaccatggaatactatgcagccataaaaaattatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatatacctaatgctagataacgagttagtgggtgcagcgcaccagcatggcacatgtatacatatgtaactaacctgcatattgtgcacatgtaccctaaaacttaaagtataataataataaataaaattaaattaaaaaaaaaagaaaatcactcaaaccatacagttacatggaaattaaacaaattgctcctgaacgaccttcaggtcaacaatgaaattaaggcagaaaggaagaagttctttgaaactaatgaaaatatagacacaacataccagaatctctggaacactgctaaagcagtgttaagaggaaagtttattagtcttaaatgtccatatcaaaaagttagaaagatctttacttaataacgtaacatcacacctagaggaaatacaaaaacaagagcaaaccaacccagagttaacataaaaaatagctagctgagctgaaagaaatggagacatgaaaaacacacataacatcaacaaaaccaaagttgttctttgaaagaataaataagattagtatagtactagaagactaataaagaaaaaaaaaaggatccaaataaacacaactggaaatgtccaaggggacattaccaccggccccacagaaaaaaaaaaaaaaaaaaaaaacctgagagactctatgcacacatagtagaaaacctagaagacattgataaattcctggaaacatacaaccacccaagactgaatcaggaagaaactgaaagagattaatagtgagttccaaaattgaatcagtaataaaaaacctacccaaaaggaaaagccttggactagacgaattcacagccaaattataccagatactataaagaagacggggtatcaattttactgaaactatttcaaaaatttgaggaggatggactcctttctaactcgttctataaggccggcatcattctaataccaaaatctgtcagagactcaatagcagaagaaaacttcaggccaatatcctggtgaacatagattcaaaagtcctcaacaaaatactaacaaaccaaatacagcaacatatcaaattcaatccatcatgataagattaccttgtttcctgggatgcaagattagtttaacatatgtaaataaataaatgtgattcataacataagcagaactagaaacaaaaatcacatgatcatgtccatacacacagaaaagcttctgataacatttaatatctcttcatattaaaaaccctgaaaaaaaggcataaaagggacatacctgaaatataataagagccatctatgacaaattcacagcaaacatgatactgaatgggcaagcgctggaaacatttcccttgagaactggaacaagacaaggatgctgactctcaccactcctatttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgagaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccatctcaaaaaaaaaaaaaaaaaaaaatcatactaatgttcacaggaaaccacaaaagagcccaaagagccaaagcaatcttaagttaaaaaaaaaaaaaaaaagctggaagaaccacactacctgacttaaaagtgtactacaaggctacagtaattaaaacagtatggtactggtacaaaaacagactcatagaccaacagaactggttagagaacctagaggctgcatatccacaaccatctgatcttcgatgaagccatccataataagcaatggggaaaggactccttttaaataagtggtgctgggataactggctaggcatattcagaagatttaaactggaccccttccttccaccatataaaaaaatcagtacagattaaatacttaaatgtaaatcctacaactataaacaccctaggagaaaacctaggaaatactattctggacataggccctggcaaagattccataacagactccaaaagtgattggaacaaaaattaaaattgacatgtgggacctaatcaaactaaagagcttctgcacagcaaaagaaagtatcaacggagcaaacagacaacacacagaatcagagaaaatatttgcaaactattcatccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaatctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatcactaccattcaactcagcaatcctagtagtggattattaactatatatttgaaggaatatatagttctaccataaagatatatgcacaaatatgttcatcacagcacttttcacaataggaaagacatggaatcaacctggatgctcatcaacaatggacataataaggaaatctgacacatttacacaatggaatactatacagccataaaaatgagatcatgtcctttgccccaataggatggaactggaggccattatctcaagcaaactaatgcaagaacagaaaatcaaatactgcatgttctcacttataagtggaaaacttaacattgagtacacatggacagcacagtaatagacactggggcctaacctacttcagggtggggtgaggagagggcgagaatcaaaaaactatctgtcaggtagtattatcactacctgggtgatgatataatttgtacactaaaccgcagcaacatgcaatttacacatgtaacaagctagcacatgtaccccctgaaactcagagttagaaagtaaaaatttaattgaagctataataaaatatagaatactaaaatggaaagtacacttcaaagacatgctataaaaggtaaataagaatatattattattttgatacaaaatattttggaattcaatctcaagataagaattattttagtttcaaattgtataatataaaattgaatgtttagcctctttcataaaggatataatgtaaaaaattgtatcacttgttttatatttattttttatattttctgcatattaacttaaattcatatttgtaaaactttattttgttgagtttattcagagtatttaatcatgaaaaggtattgtcaacataaaacgtggtgccagatggactaggttagcacaatgtttaatgctattattgcatattttggggattttttttaattgtctgctatgagctgtgtatgaagaatgactaagtaatattcagccagcacggaaagagaaatatcacattttgtcatctttatgtggaatctaaaacaatggaactcatagaggcataaagtagactggtatttacagaggctggtggggtggggcagatgaggaaatgaaggtcaaatctcagacaggaggagtatgtttcacgtttcagaaggggttctattagacagtgtggcgaatacagttaatagtagagtattctacatttcaaaattcctaagagagcaaagtttaaatgttctcaccacaaaaaatgttaaatatttgaggtgatggatatattaactagcctgatttaatcattccacattgttttcatgaattctaacatcagtttatgtctcataaatttattcaattataaattgtcaattttcaataaaaaataaatattgaaaacatcctataaacagattaataaattgttttaacattaatggcatgaatataggataaataaatttctactttttaattcccaaaatgagaaattcaagaatatcaccttaattataaacaaaaatgtgtatggtataaaacaaaacagaagtgttttgagttttttaaacacagaagacagtaaagtatacgtccaagggttgtatgtaatgggttaaaaatatgtatcaacttaaggaaggaaaacagtcatgaacgtttatgaaacagtcgtgaatatagttaattcatgttacaagctggatttaaaaataaagatagataggatatcttaagtatgtaaatcctttgaaatttgtgccagatagaataaacatactttcttttagtacttaaatgtaacagcatttagtataatctaaatgcgtgactgggattattgaataaataaatgtgactttattcctaaaattttaaattatgtggactctgaacctgcaccaaattgtcaataagtatacagacagctagaatatgctgttgaaagggatgatgttttatataaaataattccttactttattttttaaaaatctggcaaccctaaagttctaatgttttgtttcataatatttaagggtcagttaagtaatgtcttgctgagatttttaatatttaactcactctcttaaaagtctattgctttttccttttttatgcacaaaaaaatctcaatgacatgattataatctcataaaaatcatatttgtgagttaagaattgtatgttttaaacactggtttaaaaatgcaatacacacacacgtacacaaaatgacaacatcgctttgtatctttaaaaatactttaaattaaatttcatgtaagtggttttattaaatccatattgtataaaatgacatgaaagttttataaataattcacatggtcttgaaattatcaaaggagtatacacatgcattcaaaattatctgttaatagagaaatgtgtagccaggtacacatatgtgtgtgaaaacatcaatacgcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaagaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagtcaaaaaaatagcgacttcttttctgtgatgtatttatgatttgctcatttccacaggaatgacatttctaaattttgcacacagataaaactgcctaggttattttaagacatgactgatgtgccaaaattatccccactttaatacagtatcttgcaaatttgcaaatttcatttatcatgaaacttcttagaattaaaaaacagctaaactggatctactgctctggtatgttgagaaaccactgtcctaaaataacatttcaaatttcacgtgttgtgccaaggcaggatttttaaaaatgatgttttgctttaatcttaagacatacttggatgattctgaatataattattgagtaattaatgtgacacattttgacaaaggtatgtattctagagtatgttttaaattcagacaagcattctcttaacgaatcatatcagcatattcaagagggcaggcatcatttgaaaaggaaattgatctgttacacattttgacaggctttagagcatttagctgtgttctctcaattgaaaggtggtgagagtgggtaaaaaaaaacgctgtaagggtacagtttatcttgttttgttttgatttgattttaaagtggcaaacatctttctagtcacttttgcaaagacactcattttgtcaatcaggggctgtcttcaccattgatagaaaggattcctgtgggattattattacgttccatacttagttgtgtttcaacttcaatctgtttcaccaaagcaaagatacaggtgatagaagatcatcgatgttaaaggaaatcgtcgtgacaacaaatttttcttattcaccagcatggttctcaaacacttggttaggagcaataaattctcatgtaaagaaggtatatagaaagatcaatatctccttttaaacagtttaacacatttattcctaatgcattactactcactaacatgctgaatactgctatgtaatgttttaaacataacatatatttaagagtacatgctaagatcatgagtggcaaaaatgatcagttgatatttagttatagatgatatgtatcagattatatgtagctgtattaggagaaattcctgaaagatggatctggtttcttaataatgcataggaggcatctgtgcacatcattttaaagcatcttcaatttatgataatttaatcaaaaatttttttatgtttcttgaggaaatgtaccttacaaacattcctaagtgaaaaacaaaacaaaacaaaaaatataagtagaagacatatgcttttcgatatatgcagatgtgtctgtgtgtgcctaaaattataaatatttcactggagcctaagtaaagaatttactaatgtgtaagactgtaaaaatcagatatttatataatgatatgagcatttcgttcactgttataaaggcttggtaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactgctgataattacaatattaagaatttgaaaaaagaatatattaatgcatataattttacttaatattgtaactacatctaaaacataaatatatattactaaattttcaaatattttatctaaataatgtctttcttacagatatattaattcaacaaatgaattaatagagctaaaatataaattgacataatctaaagaaaacctttgccactctatttaggtattttttgttgctaaatattttatgtttttatatttaatagatttattaaatccctttggtaaacttattttgaaatattttattataattagttattcaattaaaattgcatgtaccaaattagaattgaaacaatataaaatgtcttttacagtatgcattttcctaatttatacttttcttaatttatactttcatatttgagaaattaccttttgtgttatgtataaatgttataatacatataggtaaattaatatgcctgtacaattttaggcatatatgtgtttttattcatagcaatgctaatattttaatttttttggaattataatatacttaaaatttttcatatttattctgtatatattttttctcatatacttaatgatgacaactctattgttcatattacctgatatacatggtaaatacatgataaataaaaaataaaaccctgaacaaagaaaaaagtgcaaagaaagacatgcaaagaaaggttgattcatttattctaagaaacttgagaagttttaaatatcctaacataggtgtaacttccccccaacaccaacaatctgtattacagagatggagaactgttctcacaaatacgtgttttgagaaagttcagtacaagtacacatcatggttttaaaatttttagaatattttccttatttcctatgtaaatattttccttaatatttttagaatattttcctagcaacattttgtcatgtactttttgacctattgactcattaaagatgatgcatgtagtttataatatgcctgattatcacagtcttacctttgtaacttcaacttctagaagttctgtgaaaactgaacagcaaacttcgtgttggacacataaggaagagtaggaaaaactttcttctttttgcttcacagtcttctcagcaaactctcgatgtgccccattgcccagagttacagacgcttgtgcttttagtaccacaacactgtcagtatgtcactgcttactcaatgctattttgggttctctgagtagagtcataaacactgagccttttgtgcaaaatatcataagggcactctgacgctcgttcatagtctggaattaaaatgcagacagctacgcaagtagtatgagctgattatctttgttttttttttttttcccctaacaacaagcaaaaacaaaataaagtacttattggcctgagttgataaagggagaattcaacttacatacaagaattttgcaagtagagcggacgtgccctctgtttggggattagctgatgaaacaaatgatcaatttaaagcagacccaaaacttactgaaaagagaaatgattttccactgtgtgtctatgcctcatggctgtttcttaattcggtcatttctcctcagaaatcaagtaaagacataatgagagagaaatgtctaaactttaataagtccttttcttttccttggtttattattatgtaaaatcttttattttattcatggttataattagattttgatataagctattattatttaacataaaatacatatgtattttctatgctgtttactcaagctgttatttacttaaaaaccatttttgaaccaaactagagaaacattaaaatattaaaagtttcttaaattatacctatataataagaaagtctatgtggggcaggattattcaagcatcctgttaattctgatagatattttggtcactatcctcttagcttttgaggaaagaaatggcaaaagctatatgggcagtaaagtaggacactcaagcacacacatatacacacatgcacatgtgcacacatgcatacacatacatgtgcacacacatacatatgcacacacacgcacaaatgcacatcctatgaggttgtgaatattaggaggaatcaataatttatgaacaaatcttgaagagatgaacctgggagaatagatctgtggatagcaggaacagtataatgtggaaatattttattttttcaggtagaaaaaagcattcagctagaaaaaaacacttctaagtgtttcaagatgttagtaaatagggaaaaaataaattttacaaagaacctctgaagtattcttatacatttcccccttcatattttttacagtatcaaaaaaggtggagatacctgtttaaaatatttatttacataattcactgttctgtctatgacctagtctaggatttctgtaagaatctaacattttatgagatgccaatttatatcttgatgtttataaaatatccagttgcacttaggattgaaaccacagtttagagcctcagtgtacctgtaaacatgatgtcccaaaggcttattttagagcctaagggagcaaaggtgggtcacaatttgctgccctgattattacagtaccaataaagagcaatggcaactatagaaaccacagtgagacaggattaaattttctaaagaaggtacagtgtgaaactacatgttttatgtagaatatcattaacagcaaactgattttattaaatagataatctattatcaaacacgtacaggaactagttgctgtaaattgcttaagaaatgcatgccctttctggaagaggatataagatgaacagccgatagccaaggatccagcaagattcatccgctatgccacaaccaagaatgaagacttggaagtacttaggggactggtcatcagataagcttagtgattacttctttttttttttttttttttttgagatggaatctctctctgtcgcccaggctggagtgcagtggcgcaatctcggctcactgcaagctccacctcccgggttcacgccattctcctgcctcagcctcccgagtagctgggactacaggcgcccgccaccacgccctgctaatttttttgtatttttagtagagacggggtttcaccatgttagccaggatggtctcgatctcctgactcgtgatccgcccgccttggcctcccaaagtgctgggattacaggcttgagccaccgtacccggcccagcttaatgattacttctacgtcattttctttataacaagagaaatatatctgactaatttttcatatatgggggggtaatacatagtaaatggaacatgactgtgtaagaacagaagctcaaaattaaatacactactatccatatgtaagtcagagttatcatactcagagttatctgaggtccccacagcagtaaacatgtggcaggatggacaattcccgaaacacaagtgatgttttatagctgcacagtgacattctggtctattttcacatgcagtctgggggaatttcacagttatcacctgccagcaggctaaggaacagagcttgaagttgcagaagccaggattgtattgagttactctaaataaaaatttgaattcaagtattataattcagagccaccaattttttaaaccagataattaagaaatatatatctaatgactaaccgcagacaagactggctaatgaagtttgaatttaactgaacaggcagaaatggaaagtcaaacattatgcaagctctgatctgtcccttgaaaatagacatttaaccagaaagtttaagtctacctactttatatcataggctatacatgtgccttcaattagaaatttaggccttgtccaatcaggtgttgtcaggatagcataatctaaggaccacatccttctcacatggtctggaagcattttagttcttaaaaatatatttaagttgttttgggaaaagcttataatatgttaatacaagaacatttaaaacagatatttactgtatgctatcactatatcaatgagaaatctattgactagcaagcagatagcaaaatcaaacaaaatcaaatccaaaaatgaatagaataatgaagaaattcaatgtatacatagagaaataaagtagggttaagggttagttgatccagtggcttcctactgcaatcagttatctaggttcttgggctctgtttggttctccaacttttcctcaaggccctcaaaaacactgtcactttcgtcttattcatcaaaatgatcacttgtccatgcatgaacaaagaatggcaacaagaaaagcttaaagtaattgtcattcctgaacctgagagaaagagttagttgatagaaaaacagattcatttccccaaattagagtggagtggttgaatctagttgataaccaactagacgtccagtgttcacttcagatattcatgtaaaatagcttttaaaatgctgaaaataaaaataataattttctccatggattgccattaaatggcattcttttccaacagtccaatttgctgtgttttccattctgtttttaacattgaatatatatcacaatgataaatatggggaaataaaaaaatgcacaatgatagaacaaacaataaacaaaatattcactaatctatatacttctaaccatgctaaaatactttgtatcaaaattacacaaattttgctcagagtaaagaaatattgtcttgaatatggcaacaatttgtatggtttgaagatttatcttttaaattctagttacagtagccacttgtctaatataataaaaaattttattgtcatatatatgtccttattttcttatttttgtattcattcttttttctttttctttttatatttaattaattaattaattcatttatttatttgtttgtttgttttttgagacggagtcttgctcggtcaccctggctggagtgcagtggggcgatctcggctcactgcaagctccgcctcttgggttcaagccattctcctgcctcagcctccctaatagctgggagtacaggcacctgccaccatgcccggctaattttttgtatttttagtagaggcggggtttcaccgtgttagccaggatggtctcgatctcctgacctcgtgatctgcccgcctcggcctcccaaagttgttttgtttttattttcttttgtaagaagacttttctctggagcagtatatttaagaaatatatatatgtatgtatatttgccaagccgcaacataatctccatgacggaagaaatccattatagtaattaacaatgaataaatgtataaataacaaaaaaggctcattacaagaataatttagtaattgtcaatatgcaaacaaacaacccaaaatacttaaattcagacataaacgtgtagaggtatgtcagccttgttttctgtttatattaccagaatttattagaaacatctcacctaggcaccaacctctttgaaacggtagattaacttttactttttctttcaccaggacaatattaatatgaacatttaatttctggaagagtttccatgtttttataaaattttggttacttcttaaatttatagatcatgcacatcagcattataaacattctctctggcatcatttagaattgtaatattataaaagatgtgaagttatctgtcatctatcatctctctaatctatctatgtatctatctatagtctatcatcacctattatgtttatgcaatgtattgttctacaagtcataatgatacaaagacaagactctgaccaaccacttatttgactacacatggttgaccagcgtcttgtgtttctatcattataatccctagcccaatgtattacataaagtaaatttttatttaattaaatttttattgagacgagaaatcacagggttattgtaataatgtaagggagttactttgcattgttcttgacagataacaactcctgtatttttattactactaaataataactgctattgttactatgcttaatggtaataataaagacagtagtagttggtagaaagatgaaaatcatatttccaataaaatagtaatttaaatcaaaacaatagatttaaataatatattaaaataatatatttaaattaaaataatagatttaaatcaaaagtagagaataatgcaatattaatatattaaataagcatagtgttttaaactatttttactccacattattgtaaaactgtatgtatatgtgcatgtatatatatatatatatatatatgcatatattacacaccatgctcccacatatatatgtgtatatatacatatatatatctcaccaatcttattgagcttttcttctagttttagagtttcaggtctacgtttaagtctctaattaattttgagttgattttgtatagtgtcttaatttttctgcatgtggatatttagttttctcatcatcattcattgaaaagactatcttacccattatgtgtttttgaaatctttgttgaaattcaattaactgtaaatgtgtggactaatttccgggctctctattatgctccatcagtctatgagtctgtgtttatgctaataccatgctgttttgattactgtagctttatagtagactttgagatcaggtaggatgatgcctccagtttttctcttttttctcaagattgatttaattattcggggtcttttttggttccttccaaatttgggggttctttcaatttatctgaaaaacatatttgaaattctaatacagaatgcattgaatctgtaaattactttgggtaatatgaatattttaacaatattaactcttctcatctatgaacatggtgttggtcaacagacatatgaaaaaaaaaatgctcaatattaccaatcatctggaagatgcaagttaaaagctcagtgaaatattacctcagacttagattgggttagtttagattgaccatgaaaaaatacaaaagataacaagtgttggtgaggatgtggagaaagggaactttgcacacttttggtgtgaatgtaaattaattcagtcattatagattgcattatggaagttcctcaaataactaaaaatagaaataccatatattcagcaaacctagtactgtgtaaatagccaaataaacaacaaatcagtatgtggaggagacagcttcactcccatgctcattgcaaaattattcacagtaattaagatatagaaaaaaacctaagtgtccatcaatggatgaaaggataaagaacatgtgctatatatacataatgggataatatttaaaacaaacaaaatcctgtcaacatggacaacatgtttgcaacaacatgaatgagcctggggtatactatgttaagtgaaatatgccatgcacagaataaaaaataccctaaaatatcattatatcacaggatataatgaggaatctaaaaatatggaatctaaaaacatcaaactcagaggcagcatagaatgatggctatcagaggtttgaggtggggcaatttgggagatgttggtcaatttttttttttaaattcagttacaaaggtggactatccccaagatatatattacatgttatggtgactatagttaaaaataatatattgtatatattattacaatttttacattctcaccacaaaaaaataataggtatgtgaagtaagcatgttgattagcttgacttagtcatctcacaatgcttacatatatcaaaacatgctgtatgccatagttatacaatttttgacaaaaatgaatgaataaattggttaatataatactcatacctaataaaaatagctaatatacgcttccccccagagaaaagttcaatatatttttacatattacttggtttctccttttgttacatttcaccattttactaatacaaaagatagttcacatctgtaccatttcggcaaattttatagcaccatgaaattgtcttaaaggcagattgaactctgctaaaactcagtgttgagaaatttaatttgaacgaaccactctaccctattagccccatcctagggacatttatcatgtccaggttgtatacctaaatttagtttggtgataactttgggatctagagcttgataagcaaatttgagattatgtatttgtaaccaacttcattgaggtagctgaagttcccaagcatttcatcatttgtttttgttatctaaagcaagacacataagaaaaatctgttattattaattgaaaagagataagaggagtaactaaactgtcaaatatcactgcattaatgcaataacaatagagaagagggagcaacacaaagaataaggaggccggaaacagatttatgcatgtatgagatatgagacatgacaaaattggtgtttcaaataactagggaatggttagtaataggaagaaacattttctatacacacaatttcttacaccagattttttcacagcaacaactaatttttttccaactgaggataccaaatgagggtccaaaaattccatttaattctgacactgtctacatggagttagcttcagactcacaagtaaagggctcagtcccacacgactgtccccacttaaaactgtaaatcaccagtcctgggcgtcacatacatatgaccagcttagctgcaaatcacagattaccacaacccactcttcatgttcaataatttgctatcatggctcaaacaactcagggaaacactttatttactattactggtttattaatgaatacagatgaacagccagaggaacaggtacatataatgaactatggaagggtcttgagcacagaaatttctgttcccttggagttttagggtacccccatcccagcacatggatgcaatcacctggaagctctctgaaccccatcatttacaggggttttatgaagtttccactatgtaagcttgattgataaaatcactgaccattggtaattggactcaatcttcagccctccttcatgcatcctagaagatcttttgtaaggaagtcaggactgagaccaaatagtataacaaaagaagttttcgtctttattagtcagggaattacaagtgcttaagaaactctgtgtcagaaaactggagggaagatcaaatttcttattataccatagtttggtcatttaataaatgatgtttgaaaaaattatggtagaactctatatggagaaaaatgcatttaaatttctgctttatataatagcagagaaaattcaggcagataacattaaatgaaaataaataaaagtgtgaagaaaatatgagtccgcatttttaaaatactggatatgagatatgatatctaggactggcacagatgacaggtactgtaaagataagcaatgttttttatttgtcctaatgctatccctgcatgcggggcttaaaacctggatgacaagttgatgggtgcagcaaaccaccacggaacatgtatacttatgaaacaaacctgcaatgtcctgtacatgtatcccagaacttaaaggaaaataataaaaataagacaagcaatgttacattttttactatatagaaatttaaaatggcaaaataaatagaaaccattaatttaaaagccatgtctgaaaaaaaaaaaaaacataatacacagaccagccgaaattacatctgtcatctataatta

SEQ ID NO: 202 - DNA, 5436 bp, Homo sapiens
tctcaaccttaacctcagtgcaggaaacaaatttctattaaataccatttattgttctcaatattatcacaaaattttatcctccatacctggattaacctgcttggctcctaaacgactgtgttttagaggaagccaccttgacttttaattcagtgcttctcaaaaggcaccgagcccgtggatccctggggcctctgtggacacgaaggcaatgattcagctgccccgggctggggcctgcacatctgcaccattgggcagagcccagggacactgaagatgggcctaggacctgggtttccctgtccaaccacctgtggctacttccactgcattgtatttacttatttatttatttatttatttttggagacagagtctcactttgtcacttaggctggaatgcagtggcaagatctcggctcactgcaacctccacctccctgtttcaagtgactctcctgcctcagcctcccgagtagctgggattacaggcgtgcaccaccacactccactgccacactcggctaagtttttgcatttttagtagagacaaggtttcaccatgttggccaggctggtcttgaactcctgacctcaagtgatccgcccacctcagcctcccaaagtgctgcgattacagaagtgaatcaccgcgcccggccacattgtaattatttaaaattaaagaaaaggtaccatccagttcctcagtcccaccatccgcagttccagtgctccacagccactgtggccagtggccccacactggacagctggatgggggcgtatccagcatcgcagaaagtgctccttgggtggcgctcggtttggtgacgggtgactgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagttcctctctggccacgcggcccctggggcactgagccttcctgtgggcacctgcctgggcagcttcacatgcaaatccctttctaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacaccccagaagcaaacagtattgacatgagcactaaaccaacctgtgcataggacaggctgctcattctgctcattctatttctaatgagcagaaatcagactttttaggaaacggtgaattaagttagaagccaagctccaaatgaacatttaaaagtcaacaatcaaagaaatattcctcctggtgtaacagactaagaaccctcccccgccaaaaaaagtagactattctaaaatgggtggtggaaccctatttttccaaggtaaatcatgaaatatacaatttcatttttgcaacaaacacacactggtgttgaaggaggggctacctagtagcctgcagagaccccagcatcatttcctcaggggaggctggggtcagaggcgcgggaggcagccatggagggagacaagaccccttcctgtgcaccctccagcctctgagcctctcctgccaccacgcctttcccactgccagctctggagcattctcttctcagaaggaccttgcaaccttatttctcacgtctttttttctagattccattttcctccctctagtcaccaagcctgtacctccttaagctctttgtactggtttcctggggctgaggtcacaaactgccacagactgggcagcttagacatcagaaatgtatggtctcacagctctggaggctgaaagccgacatcaaggtgtctgcagggctggttccttctgagacagtgcgggaggatctgtccctgcctctctcccaggttcccggagctctggcattccttggcttatagacggctgtcttctctctgtcttctcatcatctgtcctctctgtgtgtctgtctctgggcccaaatttcccctttttatagggagagcggtcatattggaatgggcccatcctaaagacctcatctgaccttgagcaccctcaaagaccttatttccaaataaggtcacatgtctaggtcctgggggttaagacttcagcatcattggaggacgattgaagtcataatcctctttctcctcctcagagcctcacgcctgaattctattcgcagcttatttgcctcattccataacccatgtcttctctagttttaacgtgggtcatgtctgtaataacactcttgagtgcagtggtacaatcaaagctcactgcagcctcgaacttctggactcaagccatcctcctgcctcaacctcccgagtacctgggaccacaggtgcacaccagcacacccacctaatatttttaaaattttctgtagagatgagatctctctatgttgcccatgctggtctcaaactcctgggctcaagtgattctcctgccttggcttcccaaagcactggttttatagacatcagccaccacacccggcccacatttttacaatttaagtgcagttttttggggccagagaacacagataattctatgattgggtatcttaaaaatctcatctgggaggcaacagggttaaataagaggcaaagtcataattggtcactttagccagaagaggaggatgagtgatgattcctgtggttggaacagtctttggcctgttcagtgtcatgtggggtgggggtggtgagtgtatgtgtggtgtgtggtgtgctcatgtgtgtatgtgtgtggtccgtttgagtctggatttgttacggtagtggtggccttccctggagttggtgccttgtgaagttggtgaccaggaggtgcacctgtccagccatggggttcacccacccctgcggctcccaagcctggctgccagtcccagcccagctgggggcaggtggtcggagcagggttaggggtaggggtgagggttagggtcagggagaaccttgcagcctcagcttcccattctcggggtgtagggactttcccagtgcttgtgtgccttccttgtttggtggcatctctaaaccaagaatgtcaacttctgcctttagaaaactcgtgatcctgcctgtgccaccttccagtggcatcatccccactgctgtccactaagtttggggcatctgccctgtgatctctgcaacagccttgtgtccccctcccctgtgaaaaaaagctaaaacacaggggtacaccacttaatcaaggtctcataaatagagctggaccggtgtccctgccccgctccgtcatgcctttgacaaggaaggggctgtggtgtcagtggagagcagggtttgatttcttataagcagctgcctcattgtcatgagaacacccagcctcgtcccgtggctcagcagatgagcgggagcttatgcgcatggctgttccaccagcacgtggggacagcaccgagccgtgccgtggtgtgtgcgcagatcacaccagcatcactgctgccagcctccccaccccatccctgcacctcccaccagctcccccccgcaccctgcagctggtgctttcatccacagggcagcccctctccattcccaatcctgtaatctctcctgacttctgaggcgcacacggctctttccttgtccaaattagcttcctttcctttaacaacgtagcatctcttaaaataacagccattttaccgatgctaaattataacaacaaaatcatgtgtttctttctccacccacagtagaacacaaaagcctgtgccttcgctgttctggagatgaaggcccaggctgatgcaggggagctggcgggtgggaagagagaaatgctcaagcatgtacatgtgccttccagaaccggcttccgtggcattgcttagactgctacacagtctgtcactggctcctgtgacctggctgaccatggcactaggttcctgttcatctctgttgtctttctgttctggatccatagctcagaattccgggaaatgggaaaggaaacagggaagtcgaggcgatctttaacattagtatatattttaagaaataaactgaattttcacacagggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgacccaactgtgaggtttctgagcccccaccagcctcccctcagcagctgaaacatgcagcctctcctgtaggactacagtgacagaggccttgcccggaagttcagagatggctttcccgttccctgcccatttcaaagccttcctgcccccaccagcaacatatacgacacaccttcacacacgtgcacgccccagacgagccagtaactcttatctgtttcaaaattgcctcactctgtccttatgtcttccccccagattgtgacacagatgtgaaaagggccgttggaggtgacagacaggaggccatccagccaggtactctgggaagtgcaggtggctttaggacactagagaactctcatttggtctgctggttaagctcttgcagtatgcgtgggataagaaatattaataatatgtgcaagccacgtttgatttccatggcacaacatagtggcctggtgagcactatacattgcatgaatgacaacctggtagagacggagagacatttaaccaaacccctcttgtcagaaatcctttttcactggaaagcaccagtgcattccaactcagctccacaggcacgtgtgctgccaggagggtccaggcagaggaggctgagcccagcccagacggtggcgaggatgtcaggccaagatgggagcctggtccagattcccaggcacacagacaaaagaaagctccaagagtgactgttcttgcaagagagcctcttagacaaagggctctcacaataccccagctggagtgtcactgctcccagccacaccaaccagaagtgcccacagccttgatttaattttgcaaggtggctgattgctgtggttcact

SEQ ID NO: 203 - DNA, 5840 bp, Homo sapiens
actgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaa

SEQ ID NO: 204 - DNA, 7085 bp, Homo sapiens
actgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaa

SEQ ID NO: 205 - DNA, 81213 bp, Homo sapiens
accaaaaacacatttatatttatgaagaaaacatttcaatagaagcagtagttacatggataaacatgaaaagttatataaacatattaattaaaaaagacaaataatgatacacctatgaaattgaccaagaaggaaaagcacacataattcagagctggtgcaagtgaagtttaattctgcagcaaaatttgaagaggcttttggaaaagtaattcaatgttgtatattaagaagtgtgaatcaccgtatatcaaatggtagattgtctcagggaaaaactgacattcagagtgtattttttgtataattagttttatttctgcataatttataatgttgaaatttttaatgtcactattcactcttaggagaagattgcaattgtgatataattactctgatagatattaactccagtagatactgtccagtcatatacgaacactacatattgcaaaccgaagagatgtaacacagaagattggttagaggtggcaaagggttacagggaaggctggagaagtgggcaggggagtgttgtcatccaaggaccaagagtcctcaccactggagccccatgtgcccctcactgctgagctgatgggaactctgcactccagggctgctgagagaaccctgccctggtgatgtgcagcaacccagatgcctgcatctccccaatacgactgaaactgcctctcaggtgctgaagtctgaggccccccatggtccctgttgcttatagctgctgacccacacccccatcagaaacggaaaaaagtagtttacttcttcctctcaccctgcagtgtccacccacaagggcctgcactctcagagccttacgaaaagtgaagtagcaaagaagtcaggacaaaccacgtgcaggctgcagcactgtgggtcagagactccagccctcaaacgtgcacctaaaaacaggacattgtctagacaaaggtggtcatgaaaagacctccatgatgtaggaaaatgatcaacatttttccagagcacgtctttagagaaaagttcagaggaatttggctgcaagatctaagatggcggtgcagtttcttctgtcttcttccctgttttattccaacagcctaatacagggtatacactcaatgaatatttgtagtttaaagggaagatataacatgtaaagtatcatttttgtctggtttattacattagagtcgattttaaaatttttattcaaccagttttactttagatttttctatgactttaatgacagtatttaaaacaaaaacaaagataaaaatcaaatgcaacactaaagcaataaagattgcaagtgagtgagagggaaacagactacaatcggtcctaatgaagagggagaaagatgaagatatgaagatgactccaattttagttttaatcaaggtactgatttgtggaggtatctttgacacatcagttgacctctgagtttcagattctatacctgtgaaatgttagaataaaaataacaatatcttacaacatttacttgaatattaaatgaagatcacacatatatatggaatatattttataatgtggaaaaggctaaggctgtatatgaactaactcctacatttcataaataagattttgatgatgatgagatttgagattactattactaatattggttaaaagtttgcatttcataacagaggtaaaaattgtaaaagctattagaagaaaaccagaattgttcaggagagatacctactgacttctttagctctcttaattgcattcttcttcaactcccagaggtgatgtatcaaccgaaagctttcaacccctcccctagtgcacacggtaaaaccaggcaggtcactttcttactcctgttggtgctcttaacctggccacacaccaccagcccatctaggtgaggttcaagacatcatctgatggtgagttcagccagacagacaggaggtactagcaggaagaaaagggtcatcactgctctcgacttgttctgcttctgaaacgttctattagttcttcacagcatttcctcattttttctttatcatctgtttttaatggagaaaagcaaatgttattctttcttataacttctatacaacacttatttactgtgacataatggtaaatagatttttaatttccaattatttatggacataataatatatattctatagttttagattttcatacaatgatgtatttattttcctgtcactgaagttttatagaggaaaagtgactgattttcttttgagaggggatgatttctgagggttacaaaacactagaaacaatgtctcaatcattttatgtttctttgatgaaacccacagacagtggcctaaatccaaagtgtagactgcagagggaggatggtgtccctgagaggaatcaggcagagttacgtgcgctggctctctctctcgggctgagacgtgcgttctatctcaggttaggtgtgtgatattaggcaggtaccctgagaacctgcattttttaatatgtaaagagagaaaataataggaagtaactcataggctcttgggaaagaagaaatgtaaagtattaattttagtattagtattagaacaattcctgggatgctgtatgcttcaaataaagatttgactccatttatacttacaataaatccccaagttaaacatgcattaagcaatttacatgaaagtcaaacaagcgggtacagaagaagaatgaacagggggccagttcactgtgtgtggatagtgttcccttatctgtcccgtgtcctggttgagctgttgatagtggcttaatgatagtggcttaatgatagtgatggccatttcctaaagagcagcagagatttcttaggaaaccccgcatctccctgccctcctgctccccctcaatttactgagcaaacaccttttaggtcttcacatgtgctggtcgctcctctggtccttgcttcactttggccacaaataatggacgaggtcagcaggtgtgttttgcagtttattggaatgtttttaaattgtacacagatctcagccaccatttgccagtaggggtagtgtttgatacacattatctatctatctatctatcatcatcatctattcatatatatacatatgtacataaaatgtgtctcagatttgttggatatttatattaaagcaccgaagcatcccagaatgttggaagttttggtgagttgaatgtcttaaatactttttgtaattactacaagaatacaaaatatatttgaaacttgtaaattcattccaaaatgtccctgcatcataatcacagctaaagtcttcccagaaagaggagttattatgtccttattcttggcaagggctctcaaaatttaacatttaatatgtcagaagttgaaaagttggaaagttttaatttctttcagagaaaatgtggaaacagctattatggattatttcagaacggccagatatattttgtgtctattgcccttatttattttgtaactatttaaaaattcaacttcaaatcacatttacataatagttgttccctgaatagactgactgtgacctccttaagtgcactcaagttcaatttttctttgattcatcttctgcatataacacagaggctgtgagtatcatgatagagaaggaaacagtgagttgaagtcagaggcgattcatcgtcagtataacacaggctgtgagtgtcacggtagagggagaaacagtgagttgaagtcagatgcctcagtgttgtttgattttcctccctgcttctcagtttgtatgaaagattgattgtggcaagtaataaagcacatgaggtttgcaaaaacaactaaagccttgtctgataaacagcagtgaccctccaaattctagttcttcctcgctgagatttaatgagctttaaaatgagaggagctttaaggagatgaggttggaggaccacatactaggcaggaaggacataggagtctccaaaaagctctgcataaccagggttaaaataagaaatgttatagttatatattcacctgtgtatgtttacataaatatattatatatatttatataaaaccagagtatttacacataaacacacaaatataaaatccaaattgtttttttttaaagtgggtcatatgctttattttgcagaacttctgccatttttattttgaaagtcagcttcttaaatgtatgaataggtactgaatctggagaatggaagtaatatatcttatataataatagtagcaacaatctcttaggttgtgcagaatagttagcttaaagagttaacatctacactaagagtatatgtgtttattcatcggaaactgtactattctaagcactttcattacatttcctcattttaccctcaccacacctgagctcaaacatgatttttatcctttttgatgtagattggagaaaggaatggcagacagagaaaaaggtggacccatagctggagtctactgtgtgtgggctcctcacttcacgtctctcgatgtctaaagggtcagctgtgtgtgaggacccttccctgctcatgagaatgtgaggctcgctccacgcaatcacagagcctcacagcatggcctgatcctatgggaggaggaggttcaaacatctggcataattttttttccaagttacgctttagttacttgctaaatctttcttatatcatatatacctctgagtattttgaagatgcctattgtttcttaaaccagcgatgttgattcaattcagctgtctatgacaaaaactctacaataaggagtttgctttatctttctttcaatgagtcactgtttgtgttagcagaggagggaggttctgcaaattttcagtacttgttgataaatggcattatcatcaggaaagtttatgaatttgaaccgtgacaaccttactatcagttaccaattcttctggcctatagttgtgaattcttagtttgttttgtgaatttgttatatgtcatttatatactcaaatccccagacccacgggactcaggttagcacaatgagcatacacaaatgtgagtactcacgaaacactcattacaaagggacgcgttacactgactccaaaactctccttggtggcctaggtgaaacctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcagatacttaggattttatccctgttattccttagactctcatacaatgatgcctcatctcatattcatctcattttgaggaattctttcactgtgtggaaactctattttatagtctttgtccatccaaaattcttttacaattgtgttatactaatgtaacatttttggaagttgataactgttctctaattttgtgaaaaaatattcttaacctcaggaaatacttaatatttagagacaaaaaggtcatgaggtgttcaaatgatgagagggaaagagggagggagatagagaggggcaatgaaacaaactgagttcaatgttgctgccacacatgagtatgggtaaagggtatataggtattaattgtactattgttttttaatgatttttgtgaagttgaaatcatttacaaataattaaataccaggcttttctccctttttgaaaatattctcctttctgcttggtggcagtgtgacatcttagaaatcatgctcatttcattatatctaatcattaccaagaaaatccagtcatcgccccttctttattgagggctacatttttctgcatggtccaattctgatggcgtctagtggatttatctctccgaaataattactgccatgtggtgtattgaggatgtaggaccacataagtgactgcagaaaaaatatgacacctgagtggaaggagttttaaggaaggttacctgcccagggtgattcctgagctgagatttcaaacatgtaacttgttatacaaacaagcagagggatggcatcaacattcaatccttcatttatttaacaagcattttgtactattttataattaaaaatagttaaataagattaaattttgaatagcacatggcttttaccaaggagtttgaaaaatacatgtagttgtttatgcaaacaaatgtaagaaaataaataagctgttttgatactcgtgtgaagggtgcagctcataaggacacactaattctatctgtgacatctgagttcaaacaaggagctgagaggagactccggggctcagtgctgaatagtgacgaaaagttaccctcagatgagtgtgtgatgttggagccaggggaacttgctgagacacgctgcaagggaaaaggcacagcatgagcaaagacagggctgagcaagcgagagagatcaatgcccagtagatctttcttatttcatgttaggcttatttcttgcccttgtgtggcccagggttttacaaacaatagtgaaatgatcagatttgtattttagaaatgttatttgtgtggtgatcaattggagatgtgcaagaccaaaaacatagagaccaggtacatgagaatggtaatctaaatgatgttgatctaagtggagtcgaccatgcctttacccgagaataggctgataggagggcatttgaggtggggcctgctgaacctgttacctaaaagcatacatgtggtagctgcatgctataacttcctaattggctatgtacaacttgcgaataatcaggtgttttcaacagtacacattcttcttttctctcaccacactcaattattttatgactataatataaagattctgtagtgctttggaaaaatatgagagaactagtttttaatatttttcctgaactcagacaatataaaatgcatactctaactttgtatgaattaaagagcatttgtcaactctcaatttgctggattataattatagacacatttgatggttatctttaaaacatccttgtgaaaggaaatgtagcaaaatttcatgaaaaatgatttttgtagagctttattgtgctaaaaattgttagctgcctaaaataacctgttataatatgttggtaagtctcgtggtaactacaaagcaaaaacctgtagtagacatacaaaaatttttaaaaaacaaggaatcaatgcataccactagaaaaaacatcatttaaccgtaaaagaagatagtaagaatggaagaaaagaacaaagtctctagaaaacaactggaaaactaacaaaattgtagcattaagtccctatgtatcaaaaattatcttaaatgtaaatgtattaaattatccaatcaaaagatatctggtggcagaatgtataaaaaatgccaactacaacaggttactttaacctgcaaggacatatgcagacgaagtgaagtggttgaaaaggatatcccatgcaagtcgtaaccagaaaagagcaggagtagctatgcttatatcagataaaatagactgaagtccagaactgtagaaagagacaaagaagatcatatataatgattaaaaagtcaattcaacaaaaagtatataataattgtgactatgtatgaaacattaacctaaatacataaagtattaatagatctaaggggatagatagcaataaaataatactaagaaacttcaacacccctctttcagccatggaaagactatccagacaggaggtaaacaatgaaataacagcttcaagttgcactctagggcaatggacctaaaaagcatatgcaaaacattttattcagtagctgcagaatacacattatactcgattgcacatgaaacattttctaggttagatcacatgtttgaccacaaaaaagtcttaaagataagaagttcaaaataatatcaatcatcttttctgatcacagcagtttataaacgaatgcaagaattctcagaaagtttacaaataaatggtgattaaataatatgctcctaaacaatagatgggtcaatgaaaaaattaaaagggaaaataaaaggttgtttgagacaaataaaaatggaaaactcaacataccaaaacctacaggacacagcaaaagcagttcaaagaggaagtttatagtttatagcaatgaatggctacatcaataaagaagaaagacttcaaataaggaaaggtaatattgtaccttaattaactagaaaaacaagaataagctaaactcaaaattagtagatacattaatattgattagaggagaaataaaaaaatgataaaaacaatgcaaaacatcagatgagttgttttgtgaaaaaacaaaataaactagactaagaaggttcaaatcagaaatttacaaaggatatattacaactgaggccacagaaatacaaaagattatgaaagtataatgaataattgcatgtcaaaaattagataagctggaagacatgaattgactgatacataaatcctacgatagtaaatcttagcaaaccaataatgaataatgcagtgaagtagtaataaaagtctcccaccagaaaaaaaaaaaaaaaagcccaggacaatatggactcattgcaaaattctatcaaaaatttaaagaactaataccaattattctcaaacacttccaaaaaattgaagaagtgggaatactttcaaattcattatacaaggccagaattatcctaataccaaagccagagaaggacatgggaatgaaaaaggaactacaggtcaatatcatttgggaacatggatgtaaaattcctcaaaaaatgctagaaaactgaatttaaaagcacatttcaaaaagcattcatcatgataaaatgggattcatcccagggatgcaaggatgcttcaacagatgccaattaataaacatcacatagcacagtaacagaatgaatgatacaattttatgattatttaggtggagagaagcatttgacaaaattccaaaactctcaacaaattaggtatacaaggaatgtatctcaccataacaaaggccatatatgataagcctacagctgacataatacttaatgatgaaatgttgaaagctttttctctaagatccagcaaaagaccagaacggtcactcttgccacttttatgtaacatagcactgaaagtcccagctaaagcaattagggaagaaaaataaatagaaatgtaaataggaaaggaagaagtgacatgtttctgtttgttaataaagtaatattacatataaaaaaacataaagccttcaacaaaaactattccctaacaaattcaggaaagtttcaggaaatcaacagacagaaattggagtttctatactctaacagcaaactgtatctttaaaaagttaagaaagactcatagagaggagttatagcaacaagatagatgaatagaagatcctccagcatcattcatccacacccacaaaaatagaactggaaactattcaaaaacaataacatcctgaattcccatgaattcaggagagaaaaaagagaagctgtgtctggtcttagagcaattaggtaaaagaaggaaacaaaggcctccaaattggaaagaaggaactgaaattttccctgtttacagatgacatggtcatatattaaaaaaatcctaatgacaccagcaaaaactgtgagaactgataaatgaattcagtaaatttgcaagatacaaaatcaacatacaaaattagcatttatatatgccaacagtgagcaatctgaaagagaaataaggcaatcccatttacaaaaactaaagtaaatacaaaataactaggaataaatttagccaaagtaaaagatctcttcaagaaaaactatacaactctaatgaaagaaattgaagagatcacaaataaatggaaagattccccatgttcgtggattagaagaattgatatcattaaaatgtccatctaccaaaagagagctacagaattaaggcaatcactatccgaatacaaaagatattcttcagagatagaaaaaaacaatcctaaagttcatatggaagcaaaaaagactccaaatagccaatgcaattctgagcaaaatgaatgaatatgtaggcatcatactacccgatatactacaagctattaaacatcaaaagagaatggtactggcataaaagcagacacacaaacagaagagaacccctgagagtccagatataaattcactcatttatagtcaactgatgtttgaccaagttgaaaagaacatacaccaagaaaagcactacttcctcaataaatggtgatgcaaaaaatgcatatccaaatacagaatgaaactagacacttatttcactattttaaactcaaattggattaaagactttaatatcagatcttaaactgtaaaacttctggtagaaaacacaggcagaatgcatcatcactacattgatctgggcaagaatttttaaagtagaacctcaaaatcacagggaaaaattaaaaaattaaaaaatgagattacatcatactgaaaggttcttcacaataacgaaaacaattcacagagtgaatagataacatacgagtgggagaaaagatttgccaacaatgcatttgacaaggggttcatatccagaatatataaagaactcaagtaactgagtaccaaaattatcccacaaataatttgatttaaaaaatgggcaaaagacatcaaaaaacatatttcaaaagaagacatacaaatggctagcacgtatatgacaaagtgctcaacatcactaatcatcagggaaaggcaaactgcaatgtcttggatggacatggtatctttcactttgaaactggagtcctgcaggccattttgaatattgttcatgtttcctaacacacccaagttggcagaagaccccctatttaggtctaatacctgctgtttatgctcaaataggcccaggcaatacaagttttggctatgactccagttatgtatatttctggaagaaacaatagatgggtataaaataaagtatggtagagtgaaatcatcatacctgtacaggaatgtaaatttggaggtcatttttcttatcaggacacatcacacggggaatgtgtttctttagtaaatgttgtgtactcctttagatatacttataacaaaccaacgatgcatggcatcaggataagtttagaaataattactaaacgagattccatagggtagagacaagaaattagattttgcctatgttcaagtgggagaatacccatttcaaatacccaagattatagaagaaggaatgaaaaagtttcaactttaagctgctgagggaagcttgaaaagaatttagtctgacatttgatattctttataaccatgtgactaattactcagatggtacttaggaattaagaaaagtcattaacctacaaaaagcccgaagtataagaaaacacagttaaaggtgtgttttttaattgtctttgctggattcggttagttcaatagccttgtcttcaagctctgaacttgtttcttctacttgtttgattctatttctgagattttccagtgtattttgcatttttctagtgtgttcttgatttccagcagttgtgattgttttttatttatgctatctgtttctccggagatttttccattcatgtcctgtaacacatttttaaatttaagttggtattcacctttctctggtactttgttgagtagcttaataattgaccttcttaattctttttctggcaattcagaaatttctcctttgtttgaatccattgctggtgagctagtgtgatctttgggggtgtcagaaaaccttgttttgtcatattttcagaatggttttcctggatttttctcatttgggtagactatgtgagagggaagttctggggctaaagggctgctgttgagattcttttgtcccatggggtgctcccttgatgtggtgctctaccccttcttctagggatgggggttcctgagaaacaaagtgcagagattgttatttctcttccacatctaaccacccagcgaagctactgtgctctggtactggctggtaccggagagtgtctgcaaagagtcttgtggtatgatctgtcttcaggtctctcagccatggataccagcacatgctgtggtggagggagcaggggagtgaagtggactctgtgagggtccttggctgtatttttgataagtttgctggttggtctccagccagcagttgattctttcaagagttgcatcagctgcagtagtgtagggaagatacgagcttgccttagggttacctggataagtatccagatttctcaggcaatgggccgggcctcagagctcccatgagattatgtcctttgtctttggctcccagggtgggtagagaaaggccaagaggtgggggcagtgttaggcgtgtctgagctgagactctccttgggcggggcttgctgtgtggctgctgtgtgggattggggtgtggtcctcagactgatggagttatgtttccacggggattatgagtgcctctgctgggtcatgcaggtcaccagagaagggggggaacgggcagttacatgcttcactcagctcccaggcagcccaaaaggccagtctcactcccaccttgtgcccccagtagcactgagttttttccaggcagctggtgagcagggctgagaacttgccccaggctacaagcccctcatgaagaaagcaagcagggcttttaggtttcatgcctctctgcctgcctcagcttctgagcttgtatctgcactcccagtttgccccctcccccaggttctgtccaggaagcttcacgttagtcaagattattacaaaattcatctgaaagcttgcttctccttgtagtctttccccaattccactggcagccctcccaaaggacccctgcaagacaaagtccgaaatggtttcccacagggctcttcttgttgtttcctctactcgaatattttgcttggctctctaaattcctcttagctccgcgtaagattaaatccttttcccaccatgtggaccgtcaggttccccagtgaggatctgtgcttgggggtggagcatcccccttttacactttcacacattttggcactcagtctttggcacggagcctacagtggccgccacctccttcaaagggtctttggattctcttggctttcctggtatgtcctatggtagttcttggagcaaaagttcacagcgtgaatctccacatgctgctctgtccatccaagtgggagctgcaagttagtcctgcctcctatctgccatcttcctcttctggagtccacgaaaaggattataaacaaactattttgttgggagtaataatgtggtcctggcctagtgtgaagtgaagctcactccaggccatttctctcaagctgtgttaatttgtacccttcagcagtttatgagaggttcatttccataggcccccacatctacaactaggggatttcatatatctaatctgagcagggacattggttctacatggagacagtgcagagatgagctgtgcttgaggcctcacctgtaggtggtagggtctagaccgggagacaggcattggccaacagaaataaaggacacaaagtgatgtccttctccactcacttcagcttttcttcaacactatttcagatgcttccttcctggcttagctcttcattcaaggtgagatattatgggaacaggattgtgggggcaggtggccccaggtatggagactaaggggaggtgtacatggcaagagagaagccagaatatggggatgagaaaggaacaagctgtctgtggtagtcatccatgattgagatgatgtgtggaccctgagtcagactacctggttcaaatgcaggctctctactttttacccatttgatcttggcctgtggctctctacttcttatccatttcatcttggacttgtggcctctcatacctcatcttccttacagtcctccatatgaaatccccctaaagtaggaacaaagctttggccaactgctcctcccatctttccgtggtctttacttaggaactgtgtgtttaatatacgtgacacagggtttctcccacatccctgagcagaaacaagctgtgtctgtattttgcactgtactcacccccatgctaaaccccctcatctacatcctgagaaacaaggatgtggtggggctcttcagaaagttctgggaacacatcaagtctctaaacagaacacataaatatcaatgtggaaaacaacggtagagggccaagatgcaaagacttcaggagcatctcattttccagcatgaggaatgttgctccatcgtatgagaaaaccatttggttcaatttaatttgaaatattaatttgctcataaaaagcttaagggctgggtgcgggggctcatgcctgtaatcccagcactttgagaggcctaggctggcagatcatttaaggtcaggagtttgaaaccagcctggccaacatcgtgaagccctttctctactaaaaatagaaaacttagccaggcacggtggtaggtacctgcaaccccagctacttgggaggctgatgtgggagaatcacttgagcccgggaggcggaggttgcagtgagcagagatctcaccactgcactgcagcctgggacacagagcaagactctgtctcaaaaataaataaataaataaataatgaaaagcttaagaactttttatctagtttctaaccattgtttcaaaatggctgaactcaactgtgtttctccttgaagctagatgataagcatagacaaagttccagtcttctctctttttacctgctttagccatttctcagtatcctttgaagctcaactctgtccaggtattgctaatctccattgttgtaagcatcagcttcctaggaaagacaaaagtgtgatttctcaggggcaataataacacaatagattttcttttctcttgattgctctggaaatcccaacatgttggctctattctcttatcctgtctcgggtggaaacttctggtgattctcagataagcaataactcagctgatatataatacaagaagattttctcttctataataaatacagcaagccttgagtaatagtacgtaatctgtgggtgagcaaggaacaataggcttctctcttgactttgtaagttcctcccattctcactagctctagatgcttactcttcctcgagtcagtgcaggtggaactcaggggatagagtggaagtaggggctagaaaagccctacctaccttccaccaatacagagaagcttcccttcaatttttggtggtttgattataatatgtcttaggggtagttttgtttggattgaatctgattggttactttttacctcactgtacctggttatttatatctttttccaggtttgaaaagttttctattatttcttcatataagctttctactcctttatcatttcaactcccttatctccaatgactcaaaaatttgctgttttgttgctgtccagtaaatctcatgtttcctttattatttttcattcttttctcttctctattttcatataacctgtatttgagttcacagattcattggcttgatccattctgctgttgatggtctcaactgcagtttacattttgttcattatattttgcagctttagaatttgtttgatttttaagttattccaatatttgctaagtttatcattgtggtcatattatttttatcgtttgtttgaatagtttctgtgtattttcttgaagtttgctgagcttccctaagactgttatttcaaatgctttgtcaggtagtttatgcatctccatttgtttgcttggtgatgtatgcttccttgatttctcttgcgtctgcagtcatgcatctaatataataggtacttattccagtctttgcagacttgttttatcctgaaacattcttcaatagtaagcctgtctagagattctgagcaggttgtctggtgtggtccctaagctctagtttgctgtggtgggggcagccctaggtggtgccctaagcctgggactgccacgactggtgcagtgcagtgctgtaatcccatggccactggaactggtgtgggtcccagatgatatcctgtggccactggggctggtgcagcactgatgcaagtctgaagcccatgttcactgaggcctgcctgccagtggatactttccagagcttaaggccactctgggtgggtggcagtgatgatgactgcaaattaattctgctttgcatggtttctgcctagtgttggtgtagatctggaggctcggtctttgtgtactggcctggagtcagtggttgtgggggctgcctggttttcagtttttctgtagtgggcctagtgttgggcaccaagaccaagtcccacacttacttccctttttattccccaagtgtttggtatctctccctgcactgtgctgtctgaggttggggataagaaatgcaggtaatcagaactctccttcctgccctcttcaatgtttattattttatcacaagaagaaaatagtataactaggtacaatgatctctcacatggctttactagcttttgtgaaggtatgtagtgtaagaatagttattaaaattgatgtttctatggggatacaattgttaaagaattccgttctgccagctttcccactctcctctcttttcacttttttgattgagacctttgaagcacaaaaattttgaagttagatgaggtccaattatttattttcttattgctcgttctttcggtatcatgctaaaaaaaatgctaaacttaaggtcttgaatatttaacttcatcttttctcatatttttataattttacttcttatgtttaggtccctgatcaatttgagtttaagtatgatttgtaatgccacttcattcttttgtttgtggatatcttcttgtctgagcacaatttgttaaagtgagtattcttttcccattgaatggacgtggcacacttgtcagatgattattgaccatagacacatgcgtgtatttctcattagattctcaattgtcttctatttatttatgcatatatccttattctgttatcaggcttttaaaattagtgtatctttttggcaaattttgtactcaggaagtgtaaatcttccaactttgtttttctattcaaggttgttttggattttgcagtcgctcgtaatttcatatgatttttagtgttttctactcttgcaaaaaaaaaaaaaaggcatggaatttttataggcattgtattgaacctgtggatatattttggttgtattatcttaaccacaagtctcccaatccattaacatgcgatgttgtttcatcagtttatgttttatttgctattagcagtgctttgtaattttcagtgtgttgtttaacactactttaagtttcttcttgagtaagtgttggtagtttctgtgtttccaggatttggttttcatctcactgaaggtatctagttagtattcaattatttgtaatattctcttataattgcttgtgtttctgaaaggctagttgttatgtacccatgttatattcatatttatgtattcatgatgtaagacttctctctttctctctttggtaagtttacctaaagttttctatattttgttgatcttttgaaagctcgaaatagtcaaattgttttttctattctgcattttattaatctctattccaatacttttttttccttctgtttgctttgtattgagtctgctcttctttttctagttccttaaggtgtaaaaatatattattgtttttagatgtttcttctttttttgagtataggcaatctagctaaaattttccttctaagagttgctttagctgcatcctatatgttttgttatgttttaagtcatctgaatatattttctaacttcatttccaatttcttttttgacccaccggtgcttcacagtgtggtgtttaatccccacatatgtgtaacttttgtagttctccctctatttcagatttccagttttatttcattgattggaaaagatactttgaattaaatcttttaaaatttagtcttatttgtttttggcaatttatcctggagaatgtgttattagtacttgagaagcatctatactctgctatttcagtattctccacatatatattaggtcatttggtttatagtgctgttctagtcacttactactatattaacattctgtctaagtgcactatgcattattgaaaatggacatttaagtattgaactataagtacagaactgtttatttcttcctttaattctgtccaccttggcttcatatattttgggtctctgttacattcattcatgtttacaatttttatatctaaagatctatattacattctccaaggaagatacacaaatgatcccaaacagtatacgattttttttttacttataaaaatttttgtcataaactcactttgtctcacattaacatagccactctggctatctttcggttaccaactgcacgaagtatctgtttatcttcatgtatagtatatgataaaatgttatattcacagataaaacaatttaaagtataaaattatgattcaatatgctttttaatttccttgaacactttcttttcttctaaatctattttctttattcctttatagtttattattttcatatgcttaataaattcaggaatgacaaagttgaaatacaaccaactacatagaagtacaaaaaaccctaagggactattatgaacacctctctgcagacaaactagaaaacctagaagaaatatataaatccctcgaaacaaggaatttatctatttctccacccaagattatttaacctcctgacattaagccaggaagaaattgaaatcctgaacagaccaataatgggttctgaaattaagtcagtgattaaaaaaaacctaccaaccaaaacaagccctggaccagacggattaacaaccaactcctaccagacatataaataagagttggtacaaaatcttctgaaattattttaaaaattgagaagggaatactctctaagtcattctgtgaagccagcatcattctgataccaaaattaggcacaaatacgacaaaaaaaagtaaagttcgggccaacattcctgaggaatatagacacacaatcctccacgaaataccagcaaaccaaatccagcagcacatcaaaaagtgaattcaccacgatcaagtaggctttatttctgggatgcaaggttggttcaacaagtgcaaatcagtaaatgtgattcaccacataaacataattaaatacaaaaatcacatgatcatctcaatagaagcaaaatgatttttcataacattcagcatcctttcttcttaaaaaccctcaatatactgggcaccaaatgaacttatctcaaaaaaataagagccatctatgacacacccacagccaccatcatactaaacaagtaaaatctggaagcattcctcttgagaactggaacaatttgaacaattcagttttcaatttctcatcaaaaattgtgttgacatgattgattgaagtattttatccccctttctcccaaataccaggccacagacagcatgaaatattttaaataaacattaaaataaataagtccagattggtcattaaatcgagtattttttttttattgtataaactcaagatgtacaacatgttttgatgtagatatctatagtgaaataattaccacatgctagcaaattaacacatccatcactgtctgcagtttacttttttgtgataaaaacacatataatctagttattctcttagcaaatttgtaatgtataataaaatagaactatagtccttctgttgtacattagatctctaaatatctttatgttacataactgtaattttgtcttcttttacctacattatcccaatttgtctacttccctgactctggcaactgcccttcaactccctatttatcttactcaatttccatttattttacacataaatgagctcatgctgcatttttctttctgtgcctgacttgtttcacttggcatattgtactccatactttaaaatttattaagcttaaagaattaaacaagtaagctctagttgcctaagaagttaatgtacccagaaatataaatttctcaacaatcatggaaaatgtgttacaactatatcttctttcaagtaggtcttgtaaatattttctgtattaatactgactatgctctcgtttggttgtcattctattctgagtttttaaccctcttgtttaacccaatctctcctcctcaaaaatgaataaatgcattgactcaagaaacatttatttttgagcgtctgttttggaataggtgctatattttaggcattggaaagacactagtgataaaaatggtaaaatgctttatctcctggatcttacattctatggtagagaagagataataatcgcaaaaaaactatcaggaatgataaacattataaagaagagtaaaatagggtgtgtaggagataattactgttttatattcactgctcagagatgtcttctctgataatcaagagagcagagaagagagacctaaatcagttgaagaaatgggtcacaacgtatcggaaaagagaccaccaggcagagagaatagtaatctttttttctttattcagtgtattaaatgcattgtgtttattgatataccccattagtttaatcatattccctcacactttgttattacctttattttaattgccatttttaaatttttgtgatgaacaaataaaattgtatatatttatcatgtacaatgtgatattttaaaatatgtatattgtgtggaatgggtaaattgaggtaattaacatatgcatcacctcacatacttataattctttgcagtaagaagacaaaatcaactctttgcctttatttcaaaattatttcattgtgtggtatttaatattttctatttaacaaaatgtgtatattatgtacaaatacctatgcataaaacatattttataagactaaaatatccttaatttccctctctttacacagtatctactagtttcctagcataaggaagaacagaaaatatttcagaagatatgtctattctcctttccttcatcattcaattgtagccaatatgtttacactagtgcttatcactatttctttacacttgcttttatattttctccatcatctttattattttacaatcactcacaagccacggagcagccattcagcttcgtccccatcactccctttaaattctctcctgactcagggtgattcccatttcacatctttctgttggccgattgtcgtctctttttagtgggtcatcagttctctgaaccgtcatatttctgttttaaaatgttttctcatttataaaactgctttattaaggatttggggttgtagagtatttgaagtttatatcagtatttagctccgatttaaggcaataattttggggtagatttattttttttctatagtatttttggaaagacgttgcattttctaatttcatttttaagaatttgatttgcctttccagttgttaccaggtggattgcatagggcttgcaggcattggggaatattcttgtttctcaagccctacagcttcattgtatgcattcctgctgtcttctccatgttcatttctaccaccttcctattcgtggttatgcctgggatggtgacccccttagtttaggcaagattgtcctgttatctccaccacttctttcccaggtatactccctgcatctatctcttcaataatcctcagattgctacctggctccgtgttcatcaggcttgggtatagcagtttacacttgtgagaggaccctctccttcttggggaataatatttcctggtattttttatcattaccaccaccagtgaccttgactgggtctcttctctgccggacttcctgcttccaatatggagtttctgtaccaattctgatgagtgtccgtgactttcttccccttccttacatgtaatttatagttgatggattgcctttgtctcctgatttcagtgaaggaatcatttgtgcttttttcattttttttgtcttggatgtttattatatcattggagaattaaagtaggataaaaagattggaagactatctaaaagtttgtatcagcaactaggactcccttatgtatgtttgaacagttttgttctgtttgcttttgtgagaaatgagatgaattgatgtgcaaagtgttattagttagggtgcctcaatataggcccaggaaacattggaacaccaaaatggatggagcagacatgagcagaacacaaaaaagaaataaacagcaatatgataatagtaggggattataataccccactctcaacactcataaacaacaaatggacccaaaaataaagacaatttaaaaatatcctgagacaaacaaaaatggacaaataacataccaaatcatggggtacagcaaaagtagttctgatagctactgagacagagagagaaatgatcccaaataagcaacctaacttggcactctgggaattagaaaagaagaaaaaagccaaaagttagaagaaagaagaaagttataaaggttagagcagaattaaacagataagaaagacaaaagaaaagatcagtaacacgaggagttggttctgtaaaaacgtgaggaaaattggcaaacctttaggtagacaaaccaagaaaactaagagagatgactcaaataaaactataagtaaagcaggagaaattagtcaatactaccaaaatacaaagggtcataagagattatcatgaccaattatgtcaataaattgagtaacgtagaagaaatggataaattcttagacatgtatgtcctgaagaaagaataaacctgaacaaattaataactagtacagagattaaatcaccaataataataataataaacttaaaagttcaggacttgatgcttttactggtgattgctaccaaatatctaaagacagattaatgctattctcaaacttttccaaacaattaaaaagggtgcactttccaacacattttttcatgcattaccctaacaccaatgtcagacaaggacggtataagaaaattacaggccaatttattttatgatcatggatgtaaagattctcaacactagcaaactgaattcaatatgttcaaaagatcatttagttgaatgttttctttcttctgaaattcttcattttgcttccaaatgtcatttttccttatattttattttttcattaatcaaatttaattttaaaatttccaactaaaaaaatctgtgggtttaataaacatatttttaattaacatttaaaaaaagcacaagtttgtaaattgtatattttctgtccattagattttggtttgagtattgggccaattgcacggtaagctttttaatttttttccagaagtaatcccaggaccttaaatctccactgaaactctcgaagtttaattggtcagctgggattgtagtccctggggtgttgaaagcataaataagccataccttaagtctggaccatttatccctgtagggagtccctcttctcctctgttctctttcagaactacttattactttaggttcagtgtatgtagcatatggtgactctatgggtttcagttttctgaaccccaaatatgcaaaaatatagaaaaagcagaccaggcatcccaccttctgtgtgccactaagggagcatctcttcctctttctcccctaataagttgtatattattttctcagtattttaattttttgctatttatattatctgagatttatcattggaatcatacaaatattaaaccaggaaagatcacccaggaagaaattgagatcacccacaatatcaggtattctaaaacatgttatatgaaaattgtaataattaaaacatgaatcacaaatcttgcaggtagaaatgtcaacatattaatttttttgaggaagagcaacttggatgaatatatggatgtaaacttgctgatcaactacagccaaaaattacattgtaattgtaacgtgtccctaaacttgacccattaccaatcctgataagtctgtgcttaggattatgtagattttcaaaggattgaaatgtagttgccttttccaaatcttgactagcttgtctgacaaggtaggatcatgtcaagtagattggactgaggtgatccctttattttaaagagcagtctttggcaaacactgatactagaaactgatatgattttgctcttgttgaagaattttacttattataaatgttttttaaaaacaagggaaggaaacataatcttaaaaccactcatttgtgtccatccacattatactgtagagaagactgacttttttttccaggtgattattgtagcaaaacattttaagttttattgagatcgtttgtcatgtctaaatttgttcatcataatatatcctgagcttagttcagtgcctggctcatgataaattttatttatttagtgtggtgagagcacttaacaggaaatttaccctcttacactttttcagtgcacgattcagtactgtgaactccaggcacggtgctgcacagccaatctctaggacttcatcttgtgtcactgaaaccttatacccattgcacagtagatcaagagaagaaatacttgatacacggcacaagacctatagaacacgcagggaaaacttcttctggcatcagaaaacctgttcattgctgagttcattcattatattcacctccttacaccacaatgctaacccatgaatctaactggctgtgacaaaactgtctttcataaacctacagactttaagatttatggaaagagaaagacctgtggcatcctagaattctaacatccactcttggatcatcatgaccacttagcagagctttgcattgaattccagataaagaatatcaaactcaaggatatagcagctcttgaataatgggaaagataaatgaagtgtttggcaagtagaaagataatcatgaagttcagtcattaaagtctcgccctgaacaaatgccatggacttgacatcataaaaaacataaaataggtataagtcaaaaatgtttattttgggaaattatatttaaatcaaaatcaaaaatatactcatctgaaagacaacagaaagttctgtcaccaagggaaataaaactctaattaccaaaacaaaatgtaaacaaaataaaacttacataaatatatacattcatgcattcaaaagaagttgcatagaattttatttagccatatctcagtattttggaattttgcaaacaccaagagtcgcaataataatacataatcttcgtctctcactctgttattttttcctcaagcttgggaaagataatgtgtgagtggatagagtgattctggggatcgggatgagacaattctgcttaaggcaacttctcttaggatggcaggaggtagcaagagaagaaagggcagaataaccattacagtttacaccatatttatagctataatgccttaatataatatgaagtaattactttcaattactttttaataacagagatatatacaatatatattctttaaaatggttatctaaaagtttaagaaattaaaaaaccttaatcttagaaattatctagaaatttaaatttctgaattataggtaaatgtgttatgattttcttttttcaaataagccttacaaatattttcaatattgatactgtttcattttaaatgtgccactaacatgatgctgtcatttcattgtcattctagcagtaaggattctgagtccttagcactctgtttgacccagcctctccttccaggaaatgactaaatatactcattcagagcatatttatttttgagcatctactttggggctaccactgtgttaggctttcagcacacagcagtgataaaaatgagcaaaatgtctcatcttattaatatgacactatattgtggaaaagagaaacaattgtaaaaaatatgttcaagattgttaattttatgaagaaaaataagacagcataagggacagatcagtcatttttattcattggtcattgaaatcttttctgataatcgaatagcacagaagagacctaaaagaactgaaataatgggttctagtgtatctggggaaaacgactcaaggtaaagggaaccatcatctttttcagatggcactcagagccataagaggttcagatagatccacccagcagtgagtgcagtgggtttttctaggcagaaaacacagaagaaacatcaagaaatcacatgattggcttgccatgtccaagtccttttctaattttgtttttctttttaaagcatattttttgcctgctaccatgacttgtaatttttgatgatgttgttgaaagctgatgtattcatttgctatgcgtaccatagcattctggtagtttgatgacaacctttggcattccttggcttgaagtagcattacttcaatctattcctttatcttcaaaagataatattcctgggtgcatgtccaactttttttaaataaggacaccagtttcaaaggtaaagcccagacactggttaaggtagtgaggacagattttaattagtaacatattttggggtatttgtgggtttttcacctaaaatgtaatcttacacaggctgtagattatatctctgtttccaggaagccccgtgtgttgctttgtgtgtgcatcagtctctcgagaaccccctgtgaatcaggaggcatacgttccagtgactatagggagtcgaggggctaaagaggtaagtgaaacatctggtaggggtaaaaggatgggtatatatcaaaagtcaggggtgtttaatggaaaagaggtgcatatcaaagtgtcaggggagttcaatggaaaaagttaagatggtaaaagaaagaaggaaaaaagaaggaaatgggaagggagcagtcctataagagccactttaggcagatcttaagattttcaaataaaccattgcagttccgaattatccacagtaaagtcattttgcctaaaatagaagcagacatggttagtgtcatagtatatatagagagtaggaacccaaaaggggtttaactgtggagttcctgtgggaagagtaagttcaaatagaatgaagaggtctcacaagaagccagagtgaacattccagcacaggagttaggaagtgaattcccactgaaaacagggagccaggaagataaacagccagcccaggagatgtctttcaaaagcagcctggaattataacccagccttagagactacagccagaaacataggaagaaaatatgtcctcgccatgcctcagtgcaaatttctacacagtgttaggccagaagttgaactcgccaccaaatacccaaaaaagtaagtcaactgaagatcagacaaaggtttctacgcatgcagaaaggattgactgttttgtccaagggccagataagggttccaatctggatttgagttccagtgccagataactgtcaagacaaacaaaatggaaaactggttaaagaggtaagaacgtgctttaactagtcatatactattgaaacaggcaagagttcagcatgaacttaactttgatgtatccaggttgaggaaaatgttaaagggagtttgaggaaagagaaatgggagttagtgggggctcaggagggtcagggatgtgagaaattacaaatcgtgagaaggggggagttggttcctgtgaaacccatttgctttgttaactgatacttgctgatgttgggcttctaccctcccacagaggtcaggagacaccaggcctatcttcaagtcttggctgggacaagcatgctatagattgtctgtgtacttacataagttatatgttgaaatcttaaaccccaatgtgatgatattgggagaggaagtctttgggggttgattagatcatgagtgatgaactcatgaatggccttagtgacctcataaaagagactccagagagctttcttgcctcttctgccatgtgagggcacagcaagaagaccatgctctataaatcagaaaatgggtccttacagaccaaactggctggcacctttattgtggactttccaatctgtggaaatgtgagaaataagtgttgtgtaaggccatggtatttttgttataggaaccatgaagacaggcaggtttcagttttctcagacagttcactttaagggagactgggtcgttcgttctagagatgtagacttgaactgttaccaactatgttcctgtctttttcaagtttttatagaccaaagttaaggctgaattgagaaggctcagaagaccctggctagagtttcgtcaagtttaaaatgatcgtcaactctgtatacatcaaaattgagttcagtgcgtgctggactgttttctctgtttcaatagtatatgactcattaaaatatgttgttactactttttcttcaatcatattggattagggacactttctactagagtatgttctcatcttcaattaactaattacatctgcaatggtcctatttccaaataagggtacattctgagatagttgggggtatgacttcaatatatgagtctgtggggatacaattcttaccataatttacatgatgtgttaggtaaagataaacaggcgtttagtgtgaagtttatgtttatgtgttaggctatgtttatcgctagttttacctctgatgtcagaggccataatttgctctagtgttcttatttttgtgtcctctgttatctttggcttttctacagattcattgttaaacaggatttgaggcttgtcatccttccatgtgcatcctctgttatcatacatgagatattttaatgtgtttgtcagtgtggaagggagagaaatcattctatagtcctacaaattggtctgaatctatttgccagcatgtgttcttggactgcaaccttcaaagagcttcttaacatcccctgcccacccccacataggtgtgacacaggttagaaggacctggagttgggtattttccttctagcatattggttagcctgtggtaaaaccccagtaatacggcagcctctgttaaatagtttattttttttaattatactttaagttctagggtacatgtacacaacgtgcaggtttgttacatatgtatacatgtgccatgttggtgtgctacacccattaactcgtcatttacattaggtatatgtcctaatgctatccctccctcctccccccaccccacaacaggccctggtgtgtgatgtcccccttcctgtgtccaggtgttcttattgttcaattcccacctataagtgagaacatgcgatgtttggttttttgttttgcaatagtttgctgagaatgatggtttccagcttcatccatctccctacaaaggacaagaactcatcattttttaaggctgcagagtattccatggtgtatatgtgccacattttcttttgtgtgtgtgtttttttttttgttttgtttaagtttttcttttattattatactttaagttttagggtacatgtgcacattgtgcagattagttacatacgtatacatgtgccatgctggtgcgctgcacccactaactcgtcatctagcattaggtatatctcccaatgctatccctccccccaccccacaacagtccccagagtgtgatgttccccttcctgtgtccatgtgatctcattgttcaattcccacctatgagtgagattatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgggtcttatagcagcatgatttatagtcctttgggtatatacccagtaatgggatggctgagtcaaatggtatttctagttctagatccctgaggaatcgccacactgacttccacaatggttgaactagtttacagtcccaccaacagtgtaaaaatgtttctatttctccacatcctctccagcacctgttgtttcctgactttttaatgtttgccattctaactggtgtgagatggtatctcattgtggttttgatttgcatttctctgatggccggtgatgatgagcatttttcatgtgttttttggctgcataaatatcttcttttgagaagtgtctgttcatatccttcacccactttttgatggggttgtttttttcttgtaaatttgtttgagttcattgtagattctggatattagccctttgtcagatgagtaggttgcgaaaatttcctcccattttgtaggttgcctgttcagtctgatggtagtttcttttgctgtgcagaagctctttagtttaattagatcccatttgtcaattttggcttttgctgccattgcttttggtgttttagacatgaagtccttgcccatgcctatgtcctgaatggtactgcctaggttttcttctagggcttttatggttttaggtctaacgtttaagtctttaatccatcttgaattgatttttgtataaggtgtaaggaagggatccagtttcagctttctacatattgctagccaattttcccagcaccatttattaaatagggaatcctttccccattgcttttctcaggtttgtcaaagatcagatagttgtagatatgcggcgttatttctgagggctctgttctgttccattgatctatatttctgttttggtaccagtaccatgctgttttggttactgtagccttgtagtatagtttgaattcaggtagtgtgatgcctcgaggtttgttcttttggcttaggattgacttggtgatgtgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatagaatgttcttccatttgtttgtatcctcttttatttccttgagcagtggtttgtagttctccttgaagatgtccttcacatcccttgtaagttggattcctaggtattttattctctttgaagcaattgtgaatgggagttcactcatgatttggctctctgtctattgttggtgtataagaatgcttatgatttttgtacactgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatcctgtcttgtgccagttttcaaagggaatgcttccagtttatgcccattcagtatgatattggctgtggctttgtcatagatagctcttatgattttgaaatacatcccatcaatacctaatttattgagagtttttagcatgaagggttgttgaattttgtcaaaggccttttctgcatctattgagataatcatgtggtttttgtctttggctctgtttatatgctggattacattgattgatttgcttatattgaaccagccttgcatcccagggatgaagcccactcgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccttctttttctattgattggaatagtttcagaaggaatggtaccagttcctccttgtacctctggcagaattcggctgtgaatccgtctggtcctggactctttttggttggtaagctattgattattgccacaatttcaaatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggataggtggtgatatcccctttatcattttttattgcttctatttgattcttctctctttttttattagtcttgctagcggtctattttgttgatcctttcaaaaaaccagctcctggattcattaattttttgatgggttttttgtgtgtctatttccttcagttctgctctgattttagttatttcttgccttctgctagcttttgaatgtgtttgctcttgcttttctacttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatatacccagtagtcattcaggagcaggttgttcagtttccatgtagttgagtggttttgagtgagattcttaatccttagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgggatggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgagtgctcctctgttgggtgcatatatatttaggatagttggctcttcttgttgaattgatccctttaccattatgtaatggccttctttgtctcttttgatctttgttggtttaaagtctgttttatcagactaggattgcaacccctgcctttttttgttttccatttgcttggtatattttcctccatccttttattttgagcctatgtgtgtctctgcacgtgagatgggtttcctgaatacagcacactgatgggtcttgactgtttatccaatttgccagtctgtgtcttttaattggaacatttagtccatttacatttaaagttaatattgttatgtgtgaatctgatcctgtcattatgatgtcagctggttattttgctcgttagttgatgcagtttcttcctagtctcaatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcatttaggaagcttagtttggctggatatgaaattctgggttgaaaattcttttctttagaatgttgaatattggcccccactctcttctggcttgtagggtttctgccaagagatccgctgttagtctgatgggcttccctttgagggtaacctgacctttctctctggctgcccttaacattttttccttcatttcaactttggtgaatctgacaattatgtttcttggagttgctcttctcgaggagtatctttgtggcattctctgtatttcctgaacctgaattttggcctgccttgctagattggggaagttctcctggataatatcctgcagagtgttttccaacttggttccattctcaccatcactttcaggtacaccaatcagatgtagatttggtcttttcacatagtcccatatttcttggaggctttgctctttttattcttttttctctaaacttcccttctcacttcatttgattcatttcatcttccatcactgatagcctttctccagttgattgcattgcctcctgaggcttctgcattcttcatgtagttctcaagccttggttttcagctccatcagctcctttaagcatttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtgaggaactgcgttcctttggaagaggagaggcgctctgctttttagagtttccagtttttctgttctgttttttcccatctttgtggttttatctacttttggtcttcgatgatggtgatgtacagaagggtttttggttttctcccattctatagcttgcctgttcactatgatgatagtttcctttgctgcacagaagctctttaattagatcccatttgtcaactttggcttttgttgccattgcttttggtgttttagtcatgaagtctttacccacgtctatgtcctgaatggtattgcctaggttttcttctagggtttttattgttttaggtctaacatttaagtctttaatctatcttgagttaattttttataagatgtaaggaagaagtccagtttcagttttctgcatatggctagccagttttcccagcaccatttattaaacagggaattttttttcccattgcttgtttttgtcagttttgtcaaagatcagatggttgtagatgtgcggtgttatttccgaggcctctgttctgttccattggtctatatatctgttttggtaccactaccatgctgttttggttactgtagccttgtagtatagttcgaagtcaggtagtgtgatgcctccagctttgtcctttttgcttaggattgtcttggctatatggcctttttttggttccatatgaaatttaaagtagttttttctaattctgtgaagaaggtcaagctagcttgatggggatagcattgaatctataacttactttgggcagtgtggcatatatatccaaaggattataaatcattctataaagtcacatggacacatgtttattgtggcactattcacaacagcaaagacttggaatcaacctaaatgcccatcaatgatagactggataaagaaagtgtggcacatatacaccatggaatactatgcagccatagaaaaggatgcattcatgtcctttgcagggacatggatgaaggtggaaaccatcattttcagcaaactaacacaagaacagaaaagcaaacatcgcatgttctcattcataaatgggagttgaacaataagaacacatggacacagggaggggaacatcacacaccagggcctgttggtgggttggggggctaggaaggagggatagcattaggagaaatacctaacatagatgacaatttgatggctgcaggaaaccaccatggcatgtgtatacttatgtaacgtgcacgttctgcacatgtaccctagaacttatagtttaaaaaaaagtttgctttggctttcgatgtaattctacttagacaactcttatacatatagagtaacatgtacacacatttcattttacaaattctcccttttattttgacttggcatttgacaatatcactttgatagtagcttgtgaatattagtcaagatttgtatagaggtcgggcacagtgactcatgcctgtaaccccagcactttgggaggctgagtcaggtggatcacttgaggtcagttgttcaagagcaccctagccaacatggtgaaacaccatttgtactaaaattacaaaaattaggccaggcacagtggctcacgcctataatcccagcactttgggaggctgaggtagttaggtcacctgaggtcaggagttccagaccagcctggccaacatggtgaaacccccatctctactaaaaaaaaatatatatatatataaaaatatatatatatacacacaaaaattagcgggcatggggcctgtgcctgtaatcccagctacttgggaggctaaggcaggagaattgcttgaacgtgggaggtggtttgcagtgagcagagattgtgccactgcactccaccctgggagacagagtgagattccatctaaaaaaaaaaaaaaaaaaaaaaaaatacaacaattagctgggagtggtggcacacgcctgtagtctcagctactcttgaggctgaggcaagagaattacttgaacccaggaagcagaggttgaagggaacagagatcacggcactgtactctagtccaggcgacagaacgactccatctcaaaaaatatatatatttgtatacatataacaaaatatttgcatcaaaaggacattgggtcagttgctttacctgcataaatacatcatttgaacatataaatatatcggtgtaaaaatgggcaaagtacaagaataagcaaagagtgaataaatacaaatatcaaataaaacaaatgttaatacaatacttttgttgtttgagtaaaactttattcaataaaaatagaaggaagtggcatttcccgcccatggatttatgttgaggaaagttctataggtcttcacaacatgttttaggtgatatataaggaagataattatactgtaaacgactgtggattaccattcttgacctcattactttctatccccaaatattaatcacttagtatttgaagctgaagagtcctgaagctgcaggaaaaatggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactaggaaacacctggaattctaaacaagggaaacacctcaaggcagagtgagggttcatcctccccagacattcctcttgtcaatcccaaagccacagggactaggaagcattggaattctaaagaagggaaacacctcaaggcagcgtgaggattcatcctccccagacattcctcttgtcaatcccaaagccacagggactaggaagcattggaattctaaagaagagaaacacaccaaagcagcatgagggttcatcctcccagacattcctcttgtcaatccaagaccctgtgttctatctggaaaaaaatgtttgtccttcatccacctgccatcaaggttcatgtatccattatttccttctaatgtgccagcccatctgatagacttctactaatgcttcaaaactcagctgaaatgtcacctgcactcactagctgtcctgaaacaccatccttctcatccttgtgcagaattaactgtttcataatatgtttccatagcacttgatccacactaccatttctacatttcacatttgagatatatgtatacatatatctctaactaggcaaagcaatgtatataacagactgaaaaaatacatgaccattttcccagaatatgtcacttttaactggagaatggaaccatcccactctattggcttatttacaacacgagaaacacaaatattaagagttgtgatgctttggttccacagaattgtgggatgcaaataatgactaatattttattaaaggaatcaaataagcaaacttgaattaaggagattgattaaaagttgagtaaaattgccatatactaaaatgtgttttaacatttatacaaaattcataaaataagttattgtttttggccttaaactctggaaaacagttacttatgtaattttatacttcaaaaatttgaaatatgaatcccacacactgtctcacgttaacgatcatagttatatgtttggtttccaaaacagcaaaaaaaatgaaatatttagaagcattttaataaatgtattcttatatttgaccaaacttttactttctgatttaattctgtctctatctctctgtgtatctttgtgtgtctcagcctctttcttgctttcttttcccaaaacgattgaacttcatcaattcgtcaacctcaagtattttaagagaactgtgcaattatagaaaaaagtgatttaatctgtggttgtaattttacttcatattctcattatgatacacatgaaaaaagcatgaaaacatcaatgcaaatgaagagtaaaatgcaggcagaatctggggtggaagtggaattttcaagtgatttagacttttcttttttggacagggtcttgctctgttgcccaggctggagtgcagtggctcaatcatggctcactgcagccttgacctcctgggtttaagtgatccctctgcctcagccttccaacattcagatttataataattcatcctggtgtgagaatattgtagcctgtctacgaatgttaaggataacgtttggacctgcctctcctaccaaagcctggactgaaggcaaaatggctgcgcacacaagaacaaaaaggcatcaggagaattcactaatgactcaggctgcctcttcacaaataccctgtccagctggcacctcttcaatatacttttagcaaacaaaatgatgaatatccaatttaacaaaaacgagggaaaagaagcctggttaaatttgtcttctaggatattcttatgtgattttcctcctccagtaatggagaggagagttgggaactgagcagaacatgctgaggagcacatgtttttatttacaatatgcaagtagagaagtagttctacaggaagcgtcacatgtacaaatgcattattcctgataacccgagcaacacagcataggaaagaatgtacctgtgtcagagtctcaatcaatttacatggaatatggccccagggcaaaagatgtggcatttaaaggaaagaaatagctccaggtgaaaagacaaccatgtgtaaagcaatgatatgaacacaatatgtagaaaaacctacatatgaattgtgaagcaaccattttcaaagacaaactcacatccatttaaggtaatatggaatacaaatcccactgaaaataaaatcaaattattactgtatacaataaattcaaacataattcagaaaaaaatagaatatctgcttattgctgaaattagcatctttagctgtaagttatttgcacccaaaaggaaaccagaaaataatagatataacataggcaaagcaacctaaaaaaactacttaactgcagatgaaaatgggaacacatttgaaaataaaatcctgttactactttcttgaatttagagctttcctatgatatggatatgtttatactgcttttataatcatcatacatgtataatttcatactatttttatttataatgtgagcatttttctgattaatctaaaaaatatccaccatttattaaaaatcttccctataattgaataacatgagtagtttctcttttttaaatacctacattgagcatacttttgtttgtgaatgcttataattatgtacttataatgtattttataaatacaattagtaaatctaaaacaggtacacatcagtcaatttgcacacattactagcttgatctgcagaacacgttttcaaaggatgcgccaagaaaaaaactatcacttagttaaatgaccattcagtattgcaattatttaaaaactatacaatgagaatgctgtaataagtatatggttccaccactccaaacaccatgaattttttttaaaagatatttttaagaaaaaataaaatgattttacataacaaatattaatgaattcatgaaaaacaaaaaccatataggaccacagctcagagaagaaaaatgggaggcacttactatttaaaccctaacccaaatggtcagtaaaaagacaagtaccagctactacaaaaaaacaccaaaatataaagaccaatgatactgtgaagaaactgcattacctaatgtgcaaaataaccagctagcatcacgatgacaagatcaaattcacacataaaaatattaatcttaggcagggcacagtggctcacacttgtaatcatagcactttgggaggctgagtcaggtggatcatgaggtcaggagttcaagctcagcctggccagcatggtgaaaccccatgtctcctaaaaaaaatacaaaaaattagccaggcacagtggtgcatgcctataatcccagttactcaggaggctgaggcaggagaattgcttgaacctaggaggcagaggttgcagtgagccaagatcgtgccactgtactccagcctgggcaacagagcaagactccatctcaaaaaaaaaagaaaaaaatgtatatgttatcactttggtctcatttgagtatgaatgatcagacagggaaaataaaagtaccaagaaaaataaacaagggtcttataataaaagcaacacagaatggccaaagctatcctgagcaaaaagaggaaaaaagctggagccatcacattactagacttcaaaatatactaccaagttatagttaccaaaacagcctggtattggcataaaaacagacacatgggccaatagaacagaatggagaacctagaaatagattcatgtatttacagccaactgatttttgacaaaggtgccaagaacatacactggggaaaggagagtttcttcaataaatgtcctggaacagtaatcagcagctggggctggtaccatagggatacttaaagttgaatttatcaattgctggaagctcatgtgaactaacttgacaaataaaaaaaatgttgagccccagtcttaggaaatcctccctatactcatgatttttaccttcaggagtctcaacagcttctcactgtgcaaagtagagagaaattcccttttgctttggcagagagaggagaaaataaacatttgaaatatgcccagagctctctgttcaccataacctgatctcagtagtaactatttaatgattgccattctaactggtgtgagatgatatctcattgtggttttgatttgcatttctctgatggccagtgataatgagcattttttcatgtggctgtgggctgcataaatatcttttgagaagtgtctgttcatatctttcgcccactttttgatgggttttttttttcttgtaaatttgtttgagttctttgtagattctggatattatccctttgtcagatgagtagactgcaaaaattttctcccattctctaggttgcctgtacactctgatggtagtttcttttgctgtgcagaagctctttagtttaattagatcccatttgtcaattttggcttttgttgccattgcttttggtgttttagacatgaagtccttatccatgcctatgtcctgaatggaattgcctaggttttcttctagggtttttatggttttaggtctaacatttacgtctttaatccatcttgaattaatttttgtataaggtgtaaggaagggatccagtttcagctttctacatatggctagtcagttttcccagcaccatttgttaaatagggaatcctttccctatttcttgttttgtcaggtttgtcaaagatcagatagttgaagatgtgtggtattatttcggagggttctgttctgttccattggtctatctctctgttttggtaccagtgccatgctattttggttactgtagccttgtagtatagtttaaagttaggtagcatgatgcctccagctttgttcttttggcttaggattgacttggcgatgcaggctcttttttggttccatatgaactttagttttttccaattctgtgaagaaagtcattggtagcttgatggggatggcattgaatctataaattaccttgggcagtatggccattttcatggtatttcttcttcctatccatgagcatggaatgttcttccatttgtttgtatcctcttttatttcattgagcaaacaggtgctggagaggatgtggagaaataggaacacttttacactgttggtgggactgtaaactggttcaaccattgtggaaaacagtgtggtgattcctcaggtatctagaactagaaataccatttgacccagccatcccattactgggtatatacccaaaggattataaatcatgctgctataaagacacatgcacatgtatgtttattgcagcagtattcacaatagcaaagacctggaaccaacccaaatgtccaacaatgataaagtggattaagaaaatgtggcgaagatggccgaataggaacagctccggtctacagctcccagcgtgagcgacgcagaagacaggtgatttctgcttttccatctgaggtaccgggttcgtctcactagggagtgccagacagtgggtgcaggtcagtgggtgcgcgcaccatgtgcaagccaaagcagggcgaggcactgcctcactcgggaagcgcaaggggtcagggagttccctttcctagtcaaagaaaggggtgacggagggcacgtggaaaattgggtcactcccacccaaatactgcacttttccgacgtgcttaaaaaacagcgcaccacgagattatatcccgcacctggctcggagggtcgtactcccacggagtcggagtctcgctgattgctagcacagcagtctgagatcaaactgcaaggcggcagcaaggctgggggaggggcacccgccattgcccaggcttgcttaggtaaacaaagcagccaggaagctcgaactgggtggagcccaccacagctcaaggaggcctgcctgcctctgtaggctccacctctgagggcagggcacagacaaagacagcagtaacctctgcagacttaaatgtccctgtctgacagctttgaagagagcactggttctcccagcacgcagctggagatctgagaacgggcagactgcctcctcaagtgggtccctgacccctgacccctgagcagcctaactgggaggcaccccccagcaggggcagactgacacctcacacggcagggtactccaacagacctgcagctgagggtcctgtctgttagaaggaaaactgacaaacagaaaggacatccacaccaaaaacccttctgtacatcaccatcatcgaagaccaaaagtagataaaaccacaaagatgggaaaaaacagaacagaaaaactggaaactctaaaaagcagagcgcctctcctcttccaaaggaacgcagttcctcaccagcaacggaacaaagctggatggagaatgactttgacgagctgagagaagaaggcttcagacgatcaaattactctgagctacgggaggacattcaaactaaaggcaaagaagttgaaaactttgaaaaaaatttagaagaatgtataactagaataaccaatacagagaaatgcttaaaggagctgatggagctgaaaaccaaggcttgagaactacatgaagaatgcagaagcctcaggaggcaatgcaatcaactggagaaaggctatcagtgatggaagatgaaatgaatcaaatgaagtgagaagggaagtttagagaaaaaagaataaaaagagcaaagcctccaagaaatatgggactatgtgaaaagaccaaatctacatctgattggtgtacctgaaagtgatggtgagaatggaaccaagttggaaaacactctgcaggatattatccaggagaacttccccaatctagcaaggcaggccaaaattcaggttcaggaaatacagagaatgccacaaagatactcctcgagaagagcaactccaagaaacataattgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattctaaagaaaagaattttcaacccagaatttcatatccagccaaactaagcttcctaaatgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccattgagactaggaagaaactgcatcaactaacgagcaaaataaccagctgacatcataatgacaggatcagattcacacataacaatattaactttaaatgtaaatggactaaatgttccaattaaaagacacagactggcaaattggataaacagtcaagacccatcagtgtgctgtattcaggaaacccatctcacgtgcagagacacacataggctcaaaataaaaggatggaggaaaatataccaagcaaatggaaaacaaaaaaaggcaggggttgcaatcctagtctgataaaacagactttaaaccaacaaagatcaaaagagacaaagaaggccattacataatggtaaagggatcaattcaacaagaagagccaactatcctaaatatatatgcacccaacagaggagcactcagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcagacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactaaggattaagaatctcactcaaaaccactcaactacatggaaactgaacaacctgctcctgaatgactactgggtatataacaaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaagtagaaaagcaagagcaaacacattcaaaagctagcagaaggcaagaaataactaaaatcagagcagaactgaaggaaatagacacacaaaaaacccatcaaaaaattaatgaatccaggagctggttttttgaaaggatcaacaaaatagaccgctagcaagactaataaaaaaagagagaagaatcaaatagaagcaataaaaaatgataaaggggatatcaccacctatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatttgaaattgtggcaataatcaatagcttaccaaccaaaaagagtccaggaccagacggattcacagccgaattctgccagaggtacaaggaggaactggtaccattccttctgaaactattccaatcaatagaaaaagaaggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcgagtgggcttcatccctgggatgcaaggctggttcaatataagcaaatcaatcaatgtaatccagcatataaacagagccaaagacaaaaaccacatgattatctcaatagatgcagaaaaggcctttgacaaaattcaacaacccttcatgctaaaaactctcaataaattaggtattgatgggatgtatttcaaaatcataagagctatctatgacaaagccacagccaatatcatactgaatgggcataaactggaagcattccctttgaaaactggcacaagacaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaatcagtgtacaaaaatcataagcattcttatacaccaacaatagacagagagccaaatcatgagtgaactcccattcacaattgcttcaaagagaataaaatacctaggaatccaacttacaagggatgtgaaggacatcttcaaggagaactacaaaccactgctcaaggaaataaaagaggatacaaacaaatggaagaacattctatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccacatcaccaagtcaatcctaagccaaaagaacaaacctcgaggcatcacactacctgaattcaaactatactacaaggctacagtaaccaaaacagcatggtactggtaccaaaacagaaatatagatcaatggaacagaacagagccctcagaaataacgccgcatatctacaactatctgatctttgacaaacctgagaaaagcaatggggaaaggattccctatttaataaatggtgctgggaaaattggctagcaatatgtagaaagctgaaactggatcccttccttacaccttatacaaaaatcaattcaagatggattaaagacttaaacgttagacctaaaaccataaaagccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcaaaagaaactaccatcagactgaacaggcaacctacaaaatgggaggaaattttcgcaacctactcatctgacaaagggctaatatccagaatctacaatgaactcaaacaaatttacaagaaaaaaacaaccccatcaaaaagtgggtgaaggatatgaacagacacttctcaaaagaagatatttatgcagccaaaaaacacatgaaaaatgctcatcatcaccggccatcagagaaatgcaaatcaaaaccacaatgagataccatctcacaccagttagaatggcaaacattaaaaagtcaggaaacaacaggtgctggagaggatgtggagaaatagaaacatttttacactgttggtgggactgtaaactagttcaaccattgtggaagtcagtgtggcgattcctcagggatctagaactagaaataccatttgactcagccatcccattactgggtatatacccaaaggactataaatcatgctgctataagacccatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcataatctcactcataggtgggaattgaacaatgagatcacatggacacaggaaggggaacatcacactctggggactgttgtggggtggggggagggatagcattgggagatatacctaatgctagatgacgagttagtgggtgcagcgcaccagcatggcacatgtatacgtatgtaactaatctgcacaatgtgcacatgtaccctaaaacttaaagtataataataaaagaaaaacttaaacaaaacaaaaaaaaaaacacacacacaaaagaaaatgtggcacatatacaccatggaatactctgcagccttaaaaaatgatgagttcttgtcctttgtagggagatggatgaagctggaaaccatcattctcagcaaactattgcaaaacaaaaaaccaaacatcgcatgttctcacttataggtgggaattgaacaataagaacacctggacacaggaagggggacatcacacaccagggcctgttgtggggtggggggaggagggagggatagcattaggacatatacctaatgtaaatgacgagttaatgggtgtagcacaccaacatggcacatgtatacatatgtaacaaacctgcacgttgtgtacatgtaccctagaacttaaagtataattaaaaaaaataaactatttaacagaggctgccgtattactggggttttaccacaggctaaccaatatgctagaaggaaaatacccaactccaggtccttctaacctgtgtcacacctatgtgggggtgggcaggggatgttaagaagctctttgaaggttgcagtccaagaacacatgctggcaaatagattcagaccaatttgtaggactatagaatgatttctctcccttccacactgacaaacacattaaaatatctcatgtatgataacagaggatgcacatggaaggatgacaagcctcaaatcctgtttaacaatgaatctgtagaaaagccaaagataacagaggacacaaaaataagaacactagagcaaattatggcctctgacatcagaggtaaaactagcgataaacatagcctaacacataaacataaacttcacactaaacgcctgtttatctttacctaacacatcatgtaaattatggtaagaattgtatccccacagactcatatattgaagtcatacccccaactatctcagaatgtacccttatttggaaataggaccattgcagatgtaattagttaattgaagatgagaacatactctagtagaaagtgtccctaatccaatatgattgaagaaaaagtagtaacaacatattttaatgagtcatatactattgaaacagagaaaacagtccagcacgcactgaactcaattttgatgtatacagagttgacgatcattttaaacttgacgaaactctagccagggtcttctgagccttctcaattcagccttaactttggtctataaaaacttgaaaaagacaggaacatagttggtaacagttcaagtctacatctctagaacgaacgacccagtctcccttaaagtgaactgtctgagaaaactgaaacctgcctgtcttcatggttcctataacaaaaataccatggccttacacaacacttatttctcacatttccacagattggaaagtccacaataaaggtgccagccagtttggtctgtaaggacccattttctgatttatagagcatggtcttcttgctgtgccctcacatggcagaagaggcaagaaagctctctggagtctcttttatgaggtcactaaggccattcatgagttcatcactcatgatctaatcaacccccaaagacttcctctcccaatatcatcacattggggtttaagatttcaacatataacttatgtaagtacacagacaatctatagcatgcttgtcccagccaagacttgaagataggcctggtgtctcctgacctctgtgggagggtagaagcccaacatcagcaagtatcagttaacaaagcaaatgggtttcacaggaaccaactccccccttctcacgatttgtaatttctcacatccctgaccctcctgagcccccactaactcccatttctctttcctcaaactccctttaacattttcctcaacctggatacatcaaagttaagttcatgctgaactcttgcctgtttcaatagtatatgactagttaaagcacgttcttacctctttaaccagttttccattttgtttgtcttgacagttatctggcactggaactcaaatccagattggaacccttatctggcccttggacaaaacagtcaatcctttctgcatgcgtagaaacctttgtctgatcttcagttgacttacttttttgggtatttggtggcgagttcaacttctggcctaacactgtgtagaaatttgcactgaggcatggcgaggacatattttcttcctatgtttctggctgtagtctctaaggctgggttataattccaggctgcttttgaaagacatctcctgggctggctgtttatcttcctggctccctgttttcagtgggaattcacttcctaactcctgtgctggaatgttcactctggcttcttgtgagacctcttcattctatttgaacttactcttcccacaggaactccacagttaaaccccttttgggttcctactctctatatatactatgacactaaccatgtctgcttctattttaggcaaaatgactttactgtggataattcggaactgcaatggtttatttgaaaatcttaagatctgcctaaagtggctcttataggactgctcccttcccatttccttcttttttccttctttcttttaccatcttaactttttccattgaactcccctgacactttgatatgcacctcttttccattaaacacccctgacttttgatatatacccatccttttacccctaccagatgtttcacttacctctttagcccctcgactccctatagtcactggaacgtatgcctcctgattcacagggggttctcgagagactgatgcacacacaaagcaacacacggggcttcctggaaacagagatataatctacagcctgtgtaagattacattttaggtgaaaaacccacaaataccccaaaatatgttactaattaaaatctgtcctcactaccttaaccagtgtctgggctttacctttgaaactggtgtccttatttaaaaaaagttggacatgcacccaggaatattatcttttgaagataaaggaatagattgaagtaatgctacttcaagccaaggaatgccaaaggttgtcatcaaactaccagaatgctatggtacgcatagcaaatgaatacatcagctttcaacaacatcatcaaaaattacaagtcatggtagcaggcaaaaaatatgctttaaaaagaaaaacaaaattagaaaaggacttggacatggcaagccaatcatgtgatttcttgatgtttcttctgtgttttctgcctagaaaaacccactgcactcactgctgggtggatctatctgaacctcttatggctctgagtgccatctgaaaaagatgatggttccctttaccttgagtcgttttccccagatacactagaacccattatttcagttcttttaggtctcttctgtgctattcgattatcagaaaagatttcaatgaccaatgaataaaaatgactgatctgtcccttatgctgtcttatttttcttcataaaattaacaatcttgaacatattttttacaattgtttctcttttccacaatatagtgtcatattaataagatgagacattttgctcatttttatcactgctgtgtgctgaaagcctaacacagtggtagccccaaagtagatgctcaaaaataaatatgctctgaatgagtatatttagtcatttcctggaaggagaggctgggtcaaacagagtgctaaggactcagaatccttactgctagaatgacaatgaaatgacagcatcatgttagtggcacatttaaaatgaaacaatatcaatattgaaaatatttgtaaggcttatttgaaaaaagaaaatcataacacatttacctataattcagaaatttaaatttctagataatttctaagattaaggttttttaatttcttaaacttttagataaccattttaaagaatatatattgtatatatctctgttattaaaaagtaattgaaagtaattacttcatattatattaaggcattatagctataaatatggtgtaaactgtaatggttattctgccctttcttctcttgctacctcctgccatcctaagagaagttgccttaagcagaattgtctcatcccgatccccagaatcactctatccactcacacattatctttcccaagcttgaggaaaaaataacagagtgagagacgaagattatgtattattattgcgactcttggtgtttgcaaaattccaaaatactgagatatggctaaataaaattctatgcaacttcttttgaatgcatgaatgtatatatttatgtaagttttattttgtttacattttgttttggtaattagagttttatttcccttggtgacagaactttctgttgtctttcagatgagtatatttttgattttgatttaaatataatttcccaaaataaacatttttgacttatacctattttatgttttttatgatgtcaagtccatggcatttgttcagggcgagactttaatgactgaacttcatgattatctttctacttgccaaacacttcatttatctttcccattattcaagagctgctatatccttgagtttgatattctttatctggaattcaatgcaaagctctgctaagtggtcatgatgatccaagagtggatgttagaattctaggatgccacaggtctttctctttccataaatcttaaagtctgtaggtttatgaaagacagttttgtcacagccagttagattcatgggttagcattgtggtgtaaggaggtgaatataatgaatgaactcagcaatgaacaggttttctgatgccagaagaagttttccctgcgtgttctataggtcttgtgccgtgtatcaagtatttcttctcttgatctactgtgcaatgggtataaggtttcagtgacacaagatgaagtcctagagattggctgtgcagcaccgtgcctggagttcacagtactgaatcgtgcactgaaaaagtgtaagagggtaaatttcctgttaagtgctctcaccacactaaataaataaaatttatcatgagccaggcactgaactaagctcaggatatattatgatgaacaaatttagacatgacaaacgatctcaataaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgctttt

SEQ ID NO: 206 - DNA, 368740 bp, Homo sapiens
gggttctataagtaaagatcaagagattaggtaattgtccaatttgcagcaaaggtagttttgctgaggtttaacacagagttttttctagatcataacatctcaataacatttatgcttttctcttgcaatccttctgaataatgagtttgtcaaggctttcttcattttcttactactgtgagtggtgaaaagccatgaatctgagagatattacatttatctgtgttagtatttccagatgtacaaaaccagtgtccaaatgtacactttaatttggccaaattcatttaacattgagacgatgttctgagctcctcctgggactctggtgatgtgcagaggtttaggattgtattcctaaaagacttgctaggaatgttgtagtaattgcaacatacttatataaacgtaaacctgatgactgtagttgcacaatagaattcctactgaagtctttacatgaagaaacactgatgtttctgtcagtcctttgaaaaattggttgatctacatttgatcactttatatgacaaaagctgttgttaaatgacgtgatcctatatctagtatatgaacatagtgagtattcttattatttattaatattatgatcatcatgccttttcttgactctattttttttttctttttttgagacaggatctctgttgcttaggctggagtgcagggtacaatcttggttcactgcggcctcaacctccctcactcaagcgatcctcctgcctcagccactcaagtagctgggatcacaggagtgcaccatcacacacagataatttttgtattttttatagagataaggtttgtcagggcttgtcttgaactcgtggactcaagggactggcctgccttggccccccacagtgcctggattacaggtgtgagccactgcagctggccccttgcctctatttgacgctttctgctcactcctttgcattctttttaaattctattcaggaagatataatgaattacagttgaaagcaaaactatctaaagttgctgacataactcatctagtttacaagtttagtgaaaaatcactcaaactagtccataaaattgaatggttcattcaatgtgaaaaacaaacacacaggtaaactgtggccatgagctggaataaagcaatgaatcaacaggccaagtgccacccccattcctattatttctgagactgtgagttaaggcaggttaaggtggccagaataaaataggtagttttctttctgggaaccgtcaattaaaatttaaaaaatcatttattgactgtatgtagtctctgagcagcgtaatcaggggagtgcatcgaagaagacttagtcatctaagattgaacctgaaaaggaaaattataatttgaaagtaagacaaagaaatataatatacagcataaaaagtagaatattgtaaatattctaagacatttttaagatgggttacatggtgtgtatatatctatgatttaaataccatgttaaaaaccagattaaaatcttattcactgttcaataccttgcatcagatcatgaagtgagaaatgtcagactcagtcataatttgttgagtgattaaataaataaatgaatatatgagtagatgagtaatttcatgagtaaattaaaattctgatcaattaattttcttctttaagttctacaagatagaaaaaaattgtcttctatattgtttcacagaagactatatgtattatgtatttattttctattaaggaaaatgcagtctatttagtggccatgtggagaacattcattcaatcattccacttggtcaaaatcactactttagggtttttttaagagaaagataaaaatattatctatatggacaaatttgtttacctagagtatttaagttgtaaatgaatgtaggaaatgaaattttcaaatatataatttgatcattttgttaatttgaggtaagaattgtaatttataaggaaatacctaccatactacatgagcaataagttgaagaattttcttcacagtacctaccattttaattgtatgatagttttggaaatgtttatatatagtaaatttttaagacctgtatcaccatcatgtttgatggttaagattattgagaataatttagagagctagtaagtggtttaggcaagaagcaaaccctgttttttagtccacagttttctactcttggaagtatgttatgttgccacatagaaagtcaagtttaaggcccctattattattgtactgcagtctagatcttcctttaaatcctttaatatttgttttacatatttaggtgctctgatgttaggtgcataaacatttacaattgttatatcttattgacgaattgaccctttaatcaacaaaataaagtttaaaccagagtttatatcataaataacaaaatagaagaaataaaatatttcaaatgtttaaagacttcaacttgtggtaatgtgtagcattttaccaactttaatatatttacagagatttaaggttgtgctagcagaagtccattttcagaagacttcaaacatctacatataaaagcacagaaatataagtacttcttaccaggtcgagtgatctattttgacaaaactaatgtgatttgtttagatcaattatttaaaaaacaaactgtttactgatggtgaatgactacaacattcataaaactttgaagtgcaaactctatttctttattttgattatcaataaatattgctcctatggagaaaaatagctaggttgcttaaatctgggatataagaattatacatgtagagcaaaattataatttattcaaaatacaggcacaaatgtttgtatatatgcaaatagcaacacaatattcaatcttaataaatgttactgaattccatatactaggctttcttctctaatcatggatttccatatactgggtgtgctcagtctacacctcttctttcaatgggggccggttgtagtaactttcctagtcataacaactctttagctcttaaatgaaaggaatataaggttattttctataaatgcagagatttataagcagtatagttatagtggtaatgtttcaataaaacaaattgtggcttcattcgaaagtgttccagttaaaacttaaaaaaatacttgcagagtatcaaaactttaaggtatactaattgatattacaagggattcccttgtaattttatgtatctgtctatctgtctatctatctatcatctatctgtctatctattatctgtctaacaatcaatcgattgatatatctatcagcataagtcttcagatttgccaattcagacttttactagcaagaagaaaaatctttagaataataaaattttagactaaaaattaatcaaattttaaaagcattatttgttgtcataatcttagttctctcagggttagattattatgtcaaccagtgttttaagttttattctagcttcataattcagtctctcaaactaatgtgtggagaagtcaagtcagagtagcaaaagtgcaaattattatttggtttggaaataccaagtttagtataatttattaaatcaactcaacagatacacagtgtgcttctctttacataaagcaaacagaaaaccttagtttggaatgagagtgacaatatgtgttatattttcatagcagtttgctggcttccaagcacttccacttaactaatcaactcccgttcttccctcagccacacacaccctttctcatccagcatattaccttgtgagtttttgtcaaagcacttaaaactttctggaatattttattctttctcacatgtttaacagttcagtgtcagtcttttctaataaaatttaaatttcatgagatttaggcacttattctgtttcatttattcacaaaactcctgtgatagcagcattaggtgtatatattgattgaacaatcagtgaatcaaggactacgtcactgaatgagcccatattgtttaaattgatcacagtagtacacaccatgattctgcttttacagatggagggaattttccttgggtgaagaatgttgccaactttacatggctggtaagtgggagtgatacagcccaagcctcctgtctccctcttctacagtgaaggttctgctgaaccttccatgtgataatttgtcctgcttaaaaatattttggacacatactgtatttacctaatacaataatacatgaaacttatagatggtaaaattctaattggatcatcaacataaaagtataaggaaaaattatcattagctcatcatcatgaaaatatgaagccattcttttttccccctttttttaaaaattagcctttattttaagtgcagaggtacatgtgcaggtttgttatataggtaaacttgtgtcacgggtgtttgttgtacagattatttcatcacccaggtattaatcctagtagccactagttatttttcctgatcctgttatttgaaaactgacagagtcattcaactgggcacagtctccaagttatctgctgaatgcaactggtacagaataagcacacgaggtggatgactgtggtgaaagagtagctgttcaatctggacaggtttttgcttcctgtgaaaagggaataaaatactaactttcaggattattgagagtcttaaattgatatgtgaattttatctagaacatgtctggtagtagtatgtgccctcaaaatattcctacataccaataacaatatcgatgtttctgaaaataataacaagagacagttaaggaacattcatgatgtcctagacaatttcctaaggattttataaatcttatctcatcctgatgaagcactatgacagaaagaacattttttagagttctataaaggaatggagactaagcctgtaactaaaatgcccatttcacactatgatggagaccagtattttgaagtagctaactaaaaatcaaagctaggattttaatcactacaaattattgtgtatttcccctctatctaaagaacctcaagaaactatccagaacatacatttgttcattcaattcttaagcatataaagacaatatcttcatgatgtgggtgaacagttttgttctctgtatcagaatctgtattgataaataattagcgataagtatatttgagtgaaataacttattaaaatatttatttaatatcaaatataagtaaataactttatctgacccatggaggacactaagttgcataaaatttaattttgaacaacttctaaacaacagaaacaacaacaaagcatctgcccaatttgaatataaagaatattatgtaggttcatagaggaccacttgagttgccttcaaaaatgtaaggaccaacaatgtagattacaactagaaagggatcaagactacgatatttaagaaccatctttccatcatttgattcttcgtgagtgttcaggatttctgtttcccaggtccaagcttcatcatccaccgatgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaagaaacccgagaggctcaccctaggctgttttgtgatattcatgttttcaggaataagttgtaataattgattgtggttattagataaaattggtgtaaatttaataaataaggctactaaaatgcatcatgtatcaaaatcgatatttcctttcaaaagtttttgaataattttaatatgccattgggtaaaaaaatctggtgttatgaagaagacaattctaatagtacatgttttcaagttaatgactcactaaaaaaaatcataaagcctaaaatattatctttaaaagtattttgtgttaaagttctgttctatattcatccactcttcaacttttggtaagtccaaaataaaaatggtgtcaattaattttcaaaagccatatttagtattacagaagaaatgaaaacattcagttgtgcattcattcaaagttaaatatgagaaatgtatgtttttggaggaccataagaatatgagtgaaatgcatactgtgaaaagatgagtggatttgtcaggtcatagatgaggggattagtaacactttacatagcttcccttttatgttaaagaaaagctctagatacatcatacttatcagcccacgattttactaaaaatgcattcaagtgctttggggatacatttattttattatctgttttaagtggctcacaccctatattccaatttattatcaacttcttctccatacatccattaaggcctttgaggagttaatagtattgtcttgttttgtgatggtgtcatgtatctgaaagatttattttgatggccaatagtaacagccgttatctggtagcttatattgcaataatcagtaatcccaaattcttagtaggataatataacaaaggtttacttctagtttatagtatctttcaaattcagatcgtaagcagggctctctgtactgtatatccttgaaaaataaaatgcaagataagaagccagtcacactgaaacatgattttaagcgttgaccaaaaaaatgccagttggaaaaggtgatgggagcacccacctcaaagcctaagcgactatttcatcttagagctgaacacatcacgtttatgagttcttttgtgaatatggaaataacccaaagtatccccctgcatgccttacctgactgttttggcatctgctgtggaaagagacccttgagctcacaagcaaatgaacaattgataatatttaaaaagcaacccaagtcttcattttgacaataagagttaataatgagtaatgtaaaatatatatttgaaataaagatttgaatatacattatgacttcaagggtcatcacaattaaaggataaagcactcaggtgaaatgaaatcctaatgtacatttgaaaacaaaggaagtcataaaggagttttaactttcagaaaatgatattcatttattttgagtattggaaggtaaatttccacaggcaggaactggttacccaaatgaagagaacacggaaaagtgcacactggttttgctgcctgtcccagtcatttggcccaatgcgttacatggccatacctcctgcagaggcgagggtgttgacagtttccccacacctgcaaaaaaaatggggggatcaatgatgccagtgagtgctgtgaatgatcaatatcgccctaaatgaaaatataaaatgtcagattctgaatgtctgttgctcatgcaattctactatcctgtatcctgtatgtatcctgatacaatgtgcgcatttgtatcagcaattttaaaccgtaaaatctttagcatattgcaacaagaactgtgcaacgttcttcaaatgcattatcttaggcaacactttgataacttcatgtcatggataataatgctccctcattgagcaaatgagtttctgagtttagaaatataatgcaagatagtcaatagtactcagtttggaaacagccatattttggattcctgatgctgtttattgccatgtaagcttcatcttttaacttctcttgtttttgcttatttttattgttgtttgtgtttattgaatatatgtttcatccagaagtgacagtcactccattgagggtaaagattagggaggtttagcctcaacctttacacttttctttgaatacatataacaaagtgaaatttcagttttgaattttctctaaaactcttaaatttcattccaggctcattgatacaactataatgttggctccaacaataaaatttcaccacatatgttcagtttcatttgaagaacatggggatttaggaaatcaatgtctttctatgaattccactgtgagtccaacatggttctccaaacttacacattatctcatcaacctacacagtggcactttgttagaataatcatctttagcatgtatatgagaaacaggaggcaataggaataaatttgttagaagttgaataaaaccaaaatttaattttactccaaatctccttctttagagaatgcaatttattggttacatcctgaaatatatatatatacacacacatcttatatatgcaaaatattatgcataacattacatatataactatattgcatatgtttatatacatatttacatactctatatttacatatgtaatatgtatatgtagatatatgtaatatttatgtatttaagtacttacatatataaatatgtgcaaatacatattaggtattacatatataggatgtatatatattatatcacagaatgaaaccaataaattgcattctctaaagaaggagatttggagtaaatttaaattttggttttattcaactttaacaaatgtattcctattacctcctgtttcccatatgcatgctaaagacgattgttctaacaatgtgctaccatgtgggtatgtaaatgtagatatgtacatatatacatataaaacatataatattacatattaatatgtagtagaattatatatgtgtatatgtatattagattatatataattatctatgttctctaaagtccactgatactcaatgtcatgactcagggtatcagtagaatttagagatgaggacataaaaatgtgttaggagagaaacaacctcacaaggggaagacagaagggaagacacaagggaaagacaaagcacctatttatagtttcttcctgtggcttggaaattttcaccacgtggtggcctaagtttaggaagactactttacatgatcgctaaaagttttaggaattgctgttctagtgagtgaagcagaagttgcttcatctttataacctagtcttggaagttacaaagtatattgtattggctcaaacagtcacaaaaacctgactagttttaaggagacaggtcataaaatgatgaagatttttataatctttagaaacatcaaagtgcctcaaaacccaaaataggtaaaaatagatttagacataaaacaataagcaaaatactacatttaaaatgtcacttttgagagataatatcatactatttgatatatatcaggagccaaaaacataaatttgaattttaaggatccatgtccatcagtgcaaattatcatagtactaggcaaaaagaggaatttcatatggctttcttagcataaaatgaaaataacttggtaatattctatatatatatatatattataataagtcatagaacactagacaaagaatggaaataaagtccggtgatgcttaacaatgggatatatttgagaaatgcattgttagataattaagtcattgtgtgagcatcatagaatgtacttacacacacctagatgacatagcctactacacatctaggctatatggtatggcctagtattcctaggctacaaacctgtgcagaatgttcctatactgaatattgtacataattataaaaccactgtaaatatatatatatatatatatatatatatacacacacatacctaaacatagaaaaggtacaagaaaaatatggtataaatgacataaaatgatgtgtatacctgtgtagggcagctccattatattcttatggggccacttcgtacatgtggtccattctggacagaaatgttcttatgcagtgcatgcatgtacttaaggtaccaaagtttacataaagattgatacatttattttacaattagaattaagatgggaatgatcactatgaccacaattgcttaaaattttgatgaatgtcttttagagaaaaacactaaattaacagatactctattaaaccaagaagatagtttatcaagaccagtctataaaattatgtaacattttttctatgccagcgataatgatttgagaaacatataatagagtacttgataacaaaaacaagtgtataatatataaaaattaatataacatagaatgcaaaaatctgcctcaatagatacaatttaaaagtgtaataaaagacttactagaatattggaaaaagtaggcattctgtattcaaggatgggatcacaatataaccttgtaaattccactcaatacaaatttctaaatatttattttaaagacctaatacagcttactacattattccttattataaattaactaagagataataaatgtccaaaataacttagtaaatgttgaaaagtaaagaacaaagatgagtagttttcctaatacctattgctatataacataaagtcatatttataacatcatcctgatacatcgtaatatacacatctctataatcaaatatagagaaacagttgggacactattgctctcaaaagtcaacttacaatatatgaaacagtatctaataaaggagaaattttatattgaaagaacaaaacatgctattactcgatgtaggaaaaacttgctcaacaactaaagaaaaaaattatatttctatttaaaaatatatagaaactagacttcagattaagacttaaatacataacgtaatgctatagagttacttgaacgtaatagaaaataatctctttctcataaagtggaagggacacataacttcaacagcaaaagattaatgaaatatatttaattacataaaaattaataatatttatctagtgaatgacatcatgggcaaacaacatactaatacaaattgaaagaagataatttgcatctcagagacaaataagccaataaaacctaaaatattcaatgtattcctacacatcttaggatgcccattttaattagtaatcagataattacttaatcagagaattaattacttaatcagagaattacttaagatgcccagtttaatttgtaatcagagaaagggcaattaaacaaaataaaatattactttagatccaataaattagcaacatttcaggagctgaataatgctaaatggtgcaaaagatgtgaatgaataagaacgcttggaactacatttgaaaacatgatctgatgttggtatctttcttttttttttttttattttgagaaagtctcactctgtcatccaggctggagtgcagtggcacaatcttagctcactgcaacctccgccctctgggttcaagcgattctcctgcctcagcttcccaagtagcgaggattacaggttcatgctaccatgcccagctaatttttgtatttttagtagagacagggtttcgtggtgttgatatcttgaagagcaatctgctggtgtctaggaaatttatattttcatatcaattagaagtcagcaattctgcctaagcccatttataccaaacaaattctcagaaaggtccagaataaagaaaataatccaaacaagttaaatattatttttagttataaataagttatcaataataacatggaattaaagcacaaaattgtgattttttaaaaacaaagccaagatttaagtagcttacgatggaaaataaagcataaagaatgcttaatgcatttttttttgacatggggtctggctctgtcactcagcctggagtgcagtggtgagattatagctcatggcagcctagaactcctcagctcagtctcctgagtagcaaggactgcaagtatgcgccaccacacccaacacatttttaaattttttttgtagagatggggtcttgttatgttgcccagcctggtctcaaattcctggactcaagtgattctcccacctcagcctccccaaatagtaagattatagatataagccactgtgcccagcctggaatgcttaatactgtaaaagcaaataaaataatgacacaagataacacatcttcagtaacatcaagatttgtttataagctacagaaataaaaaccaggtagggggttgggggaaagaggagggaaagcattaggacaaatacctaatgcatgcgggagttaaaacctagatgatgggttgatgggtgcagcaaaccaccatggcacacttttgcctatgcaacaaacccacacatcctgcacatatatcccaggacttaaaatacaataaaatttaataaagtagaaaaaattattaatatatacacatgaaatataaatatatatgcacatacacatgtggaaatagaaaaaatgcgcacaggatttgacagatatttcacaaagcaacagttaaacacatcaaaagtcatgtaaacattagtaatcaaaaaggcacattgaacaatgatgcacctatcaaattgactaagacggaaaagtgcatagaattcagtcctggtacatgtaaagtttattgctgtgatgctgtaacacaagttgaaaacatttttggacagggaatttagtttatggatattaagaaatttgaaaactttgtatcttcttgcaaatcactttaggaaaaaacacacttagagaatgctatctgggaaaggtggcgggggagagtatacggaaatgttggtcaaagagttaaaagttgcagttgtgtaggataaataagtctagagatctaatgtatagcttgatgactatagctaataatattgtattgtacactgggaagtagccaagagagtaggtttcaggtgctcttagcacatgtagacacacacacacacacacacacacaaagtaaagatggacatgcttattttcttgactgtagtaatagtaataatttcactatgtatataaaaatatgttgcataccttaaatatatacaataaaaagagaatcctttgtacataagctattaaaaatgtcaaacaatttatcacttagaaatttgaacacaacctaaataaccactatttggattttaattgtggtataattaatttgataggatatcaatgtctagtcacatatatacacttaacctattttaaatagaatagatttaatgtacaaaagtggttacagggtggcacaaagggctggagggaaggctgatgcagcaaggagccgagtgttatcactcacagaccaggagttgtcaccagtggcgcctcatatgctcctcagtgctgagctgatggagaccgcacgcccagggctgcttgtgtgactttcccatgctgatatgcggcaacttagatgccctgcatccccacaaatgcagctgaaactgactgtaagcccacaactccctcaggacccctgctgcctgcagttgctgctgctgccgccacagatcatcaccagaagcaggaaataagacacagtttccttctttctcctgctctccagtgttccaccagggcctgccctctcatagccttacaggaaaccaggtagcacaggagtcaggacaagctctctgcgggctgaagccctagaagtcagcggagacaccagccctaaagtgtgggcccaacaaacagaagacagacaccatctggacaaacgttttcatgaaaagacttccgtgacatggtaacatgatcaacatcattctagaacacacgcacagaaaacggttcagaaatacttgtctgcaagatccaagagggtggagttgcttccacctagttacctattttattccaactgtctgctacatggtgtacacttcataaatattcatagtatgaagtcaagacatgaattttaaagttttgtttctatctgaactattacattatggttgatttttaaattttatttgtactagactgtgattttagattttttagtcatatcaatatttaaaataaaaacaaactttaaaattaaatgcatcactaaagtaacagagcttgcaggtgaataacagaagaaagaacataacaagctaatgaagagtgatagcaatgaagatgtgaaaaagacaacctcaattttagtatggagttcattactgatcagcgatactctctttgacacatcaactgaactctgagtttcaaagcctatatttgtgaaagattggaacacaaatagcaatattttataaaaatttcctaaagtttaaaggaggaggcacatacacatgaaaatattgtgtaaaacacaaaaggccatatataactaactcatatatcataggtaaaaattcattagtaatggctaactttgagattattgttaatatttgttgagattttcagtttaacaataaaagaagattaaataacaacaacaaaacagctgggcacagtggtgtgtgtctgtagtaccagctattcaggagagtgatgtggagggggttcacttgaggccaggaggtcgaggcctttgtgcactgtgatctcacctgtaaaaatctactgcactccagcctgggcaacatagtaagattctgtcgcttaaaaaaaaatgagaagaaaatcagaaaagggcaacagagatatctattagcttctttagctcctttatttgcattcgtcttcaaaaccccagagaggacttattaacagaaaacttttatctacacccctaatggacacagtgaagccagggatgatgtcacttttgtttttctttgcacacttaagccagccacacaccatgagcccctccaaatgagggtcaagacatcatctgatggtgagttacaccagataggtagacagtattgcaggaacaaaagatggtcacggttcttgacttgttctgcttttgaaacatttctattagttcttgactgtatttcctcatttccctctatcatctatttttatggagaaaagccaatctgttttatttttcctttgagtctcattttatataatacttatttactgcaacatattagtaaacgggtttttcatttccaaagtatttatggacaaaatcatatatattcttcctctgttattgaatgatacatttgttttagtgggatgaaaattttgcagaggaaaaacaactaatttttctttgaatggaaattaggtcttagagttagaaaacactagcaacaaatgtttcaatcatatttatgtttccctggtgaaaccaatagtgagttatctaaaacccaaattttagtctacggaagcaggactgtgtccccaagagaactgaggtaagtgacatgctctgggtcccgcacctgcaccgatgtacttactccatggggttagctgtgtgatgttagatagataccccagaacttgaacttttaaatctgtaaatggtgaaattagattatatacctcataggttcttgaggaaaattaaatgtggtaaactggcattaagaacaattcctaggatactgtaagcttcacataaatgctcaatattgccctaccaccactattaattattccctgggttaaacatgcattgtgctgtttggaaactcaagcaatgtgatcaagaaaaataaaagaaagaaaaagtccagttgtgctgcatgctgcagtcacagttttccctcactgatctggtgtcccaggtcagctgttcagcgtggcttaatgacagggacttccatttacaaaagtgcagcagagatttgcccagcatccacctcccatcccgcactgccctcttggtctccctccattcacttagcaaacagctgcccagtctccgcatctaattattattctccaaaacttgaaaatattaataagtctaattagaattattaaaagaattcaaaatgtatttgaaacttggaaattcttcctgaaatatgactgtatgataaccactgctaaagtcttccctgaaaaaggaccctatattttcttcctattgataaatactaaaatttaacaacatgtcagaaatcgaaaagttgcaaagttttaatcttcttaagagaaaatgtaggagttatcagtgattctcttcagaaaggttaaatgtattttgcttctattagccttgttaatgtagctcatagctattctaatctgaagttgtactttaaatcatgtttatatgttttttcctgaatagactgactgtgacctcctcaagcttaatcaaatataatttgtctttgattcctgcactagctaacacagagtcaggctgtgagtagcaagatagaggaaggaatttaattgaagtgagagacatcttagtgttttattttcttttctgcctcacagtttccgtgaaaaaattcactgtagcaggcaataaagcagatatttgcaaaaacaccaaaagccttacctggtaaatagcagggagtttctaaatcccagttatgcccccctgagatttaatgcgaatgacaggagctttaaggagttaagcttggagaagcatgcactagtcacaaagaaggtggattctgcataaatctctgctcaacatgaaaataagagacataccttacattaatatatgcatttctatttgtaaatatgcatatacaatgtattcttatatttgtaaatctgcacatatataaaaatgcatatctataaatttatataaaataaatgtaaactgtatacatacaagttgtctgggactagagaaattatcaaatccaaattcttacaagtctgactaaatgataaaatcagcaaactgaagtaatgaagctcatatcataagatgattatagtaatacagtctgcagaataatttgtgtagatattaactctttgacagtgtatgtatttgttcatttgtaactggtaatattctaagcactttcattacttttctgcatttaatcttcatcaaccctgaggtcaaaccttttcttaccatctatttttatgtgcagtaaacagaggaatagcaggtagaggggaagctgggtccaccctgcagtccagccacggtccctgggctcctcaccccatgcgactctggtttctgaggagtctggtgtgtaggaggaccctggcttgctcatggggatgtgtggggttttgctccacgaaaccacagagcctcacagcattgtccaatactgtgggtagaagggtgcaaatgtttggtatggattttccacaagtgatattttagtcatgttctaaatcattcctatatggaatacacttttgggagtttttaagattccagatggatccttaaaccagagaatgtaattcactttagacttctctaaacaactctaaaaacagggggacaaaattctcctttgttttcaataattcactattcatgtctgcataaggcagtgacactgccagtttccaggacttgtttataacagacactctcatcgggaaatctcatgactcagaactgtggcaacttcactacaaatcacccttttgatccacagttgtgaattcttagttcctggtaaattttttgaattgcagataatttataacacccaaatctacaggcccatgggcctttctttggttagaacacacacacacacacacaatttgtttcagaggctcaaattactttaaccccaagctttcctttgtggcctaggtgaaacctcatggacaacatcacctggatggccagccacactggatggtcggatttcatcctgatgggactcttcagacaatccaaacatccaatggccaatatcacctggatggccaaccacactggatggtcggatttcatcctgttgggactcttcagacaatccaaacatccagcactactttgtgtggtcatttttgtggttttcctgatggcgttgtctggaaatgctgtcctgatccttctgatacactgtgacgcccacctccacacccccatgtactttttcatcagtcaattgtctctcatggacatggcgtacatttctgtcactgtgcccaagatgctcctggaccaggtcatgggtgtgaataagatctcagcccctgagtgtgggatgcagatgttcttctacgtgacactagcaggttcagaatttttccttctagccaccatggcctatgaccgctacgtggccatctgccatcctctccgttaccctgtcctcatgaaccatagggtgtgtctcttcctgtcatcaggctgctggttcctgggctcagtggatggcttcacattcactcccatcaccatgaccttccccttccgtggatcccgggagattcatcatttcttctgtgaagttcctgctgtattgaatctctcctgctcagacacctcactctatgagattttcatgtacttgtgctgtgtcctcatgctcctcatccctgtggtgatcatttcaagctcctatttactcatcctcctcaccatccacgggatgaactcagcagagggccggaaaaaggcctttgccacctgctcctcccacctgactgtggtcatcctcttctatggggctgccatctacacctacatgctccccagctcctaccacacccctgagaaggacatgatggtatctgtcttctataccatcctcactccagtggtgaaccctttaatctatagtcttaggaataaggatgtcatgggggctctgaagaaaatgttaacagtggaacctgcctttcaaaaagctatggagtagaccattttgagagtaatttacttttccttctctctgcacttcacatatgagaatgttataccagtgttatttcccagactccaagactgccatggtgtttgatctcattttcacacctcttttagaaatcgctttcctgtactagaaacttttcaatttacactccgtctcacttcaaaatgcattattcagtcatattatattgatgttacagttactgaagttcataactactttctaattctataggatattttcatattctgggaatacataatgatactacttagaggataaaggttataaggcataaaattgagagagagggagaaatgaggaagaaaaagggttcatatagatgttctttgtactacttttatttatgctaattttctgtaaaattgaaattaattttaaataaataattaaaatatgtcccctccctcccaccttttttgagcagtacacatgatataatatcttagaaaacttgctgattgcaatgtagttattcactgctgagacaatccagccatttgtccacccttattggaggctgtcttggcccacatggttggttcctgaaagattaaggtctgttattgaggttaacagtcttcatcaagtgctgggttttgaatcccgaattccgttaagagactgtggaaaacatattagcctggggtgaaaagaagctttagagaagatttccagcacaaagtgacatctgagctgagttttgaagtatgtaatttattagacaaataagaagaggtagagtatcaaatatccaattgttcatttatccagtaaatatttgttatgctatattaaatctaaaatattcactaaagaaaattcaaaggtgaatactacatactgctttccccaagaaatttgaactagtaattctgtgtgcaaataggtgctataaagtgtatgaaatgctttgatgcacatgtggaaagggtatagctcattctggcacctcgcttcttcctgtgctgtgcacattcaatcaagcagaagatgctgagtgcagccccaggagctcagtgttaaaggtgcctagctgttcccctcagataactacacatggctggggaagggggagggactttgtcagggatgtgattatgcctgggaaaaggcacagcaagagcaaaggtcagacaattgaccaagcaggagtggcaaatattctaatcgtgccttctttcctgttttattttgtggaataattccttgctttctgtgacccagatgtttacaaacagtagaaaatgatcagtcttgcatttcagaaatattactttggtgacaatagattggagaagtgcaaacctggtggcaggcagaccaggtgagtgaggatggtgaaatgcacgaactcagtggaacgatgtgtaccttaccaccaggagggacttagggagaggaaatgtttggggtatgcagggatgtgagactttgtcaaaccaattggattataattacagacctagttgcaggtgtatcattttccaattgcctgtgtccaacttgtgaaaaatcaagtggcttcagatttacagattctgctttcctcttgacaatatgatcctaaacatgtaaaacttaaaatctccacaaaagctctgttagaacaattgaaagccttcacataaagttgcagaaatcaaaatcaacatacatcaataatttttctatgcactaacatcaaactacctgaaaaagaaatttaaaaacaattttatttataatagtgtcaaatcaaacaaacaaaaactttgggataaatttaaccaaaagggttaaatatctacactgaaaaacataaaacattgatgtaggaaattaaagaagacaccaataaatgagaactatcccatattcatggattggaagaattaatatgttaaatttttcatattacccaaaggggtctatacatttaatgacattcttgtcacatttcaatgtcatttttcacagaactggagaaaaaaatgatttatatgaacagtaagaacaaaaggggagcatcacactactttttttctaaatatattacaaagctatgacactcaaaacagcatggtacacgcattacaaaaggcacattgaccagtggaacaggatttagagccgagaaataaacccacacatttatagtcaattgatttttgacaaatgtgccaaaaacacacctgaggaaaggactgttccttcaacaaatgatactggaaaaattagatatccacatgcaaaagaacaaaattgaacccttttctcacaccatatacaaaaatcaattcaaaatgaattaaacttggatataagacccgaaactgtaaagctactagaagaaaatatagggaaaagctctgtgacattggtttgggcaatgtttttctggatataaactcaaactcccatggaacaaaagcacaaataaacaaatcagattatgcaaaactaaaaaggttctgcacagtaaaggaaacaatcaatagagtgaagggacaacccacagaattagataaagtatttgtaaactatattatctgataagggattaatagaaaaaatatatcaggaactcagaaacctcaatagtaagaaaataaataacacaatttaaaaatgggcataagacctgaatagacatttctggaaagaagacagacagatggccaacaggtatatgaaaaataatgcttattatcactagtcatcagggaaacacaaaacaaaaccacaatgagatatcacttcactcttgttagaatggctattatcaaaaagacaaaagataacaagtgttggtgaggacatggagacaacttccctccctcccacctccaactttgagggtacagtgggctaaactgaagaatgcatgagctgggggaggcagaggatgctgggtcctgtctccccactctcggggccgactccttgacctgatacaggcagaacaggtgaggccccgaggctttaccttgactgagagctctagctgtgagtaggatctaggcatgttagtaacgactgattctggactgaatgtgctgggaggtcatttgaaagtctaggaaggttgaaaaaacctcatagcttgaacaggcatttgaatgaaacctcaaagttcttttgtgcttgtaacttgaagacatttgctctttggaaatagcatacacatatacagaccatctatatggtatacacagatgacaaaggtttgtgctctccatagtttcttttcttctttatttgatggatttattctttcttgcacacctgtaattatatttctcttgacaccttgctgtatatcaacttcttgagttacactccttgtcaatagttgaaaagtttctgtctttcagcttccaacaaatttgctgacgagtcagttgctgctcagattttttaaaaatcaattttatataagtagttctttctatctggtgactgcaaaatgttaacttgcatttactctgaaaataattcatgtacatattttaacttactgttacaattgctaactgttgttaatgtataatttctataaatgtatatctattgcgttgaatatcagagtattaatttaaaagtggtactttttacatatataactaggagtggaatagcagggtaatataataattctatactttgtgttttgaaaagctgtcaaactgttttcaactatggctgaaacattttgcatttccaccagcaatgcatgagtcttaatttctccatattctcaccaacacttattactgcttaatgagtaaggggttttacagcttgggatcgtggaaatgttttggaactagaggttgttgttgcccaatattgtgaatgtataagataccactgaattgttcactttaaaatggttaattacattgcatgaagttcacttgaataaattatttttaagtggcgctgtttgtttggaagactatgagagaaatttattttcacatagggttatcccatggaactaggcaaaatcttgagaaatagtatttccaaataattcacaataatttttcaacttattccaagaagacaacttctctaaaaacatgtaacataatgggcctggtcagttcttggttgatgctttgactctttcagtgtttcttattttaaaacatgattttaagtttcagttttggctgggagaaaataccctgtctaaagctgtatttcagcctcttgctttcagatttaccaaattgtctttgtttgacttaaaaaaaatttttagttgtctgtttccaacatatttgcattgttgatttaaaaaaactttgaaaagcatgtgtgttcatttgagaataattttagctcatttttgataggggaagtgtataatttattttattagttctaagtcctccttatttctaaattttatttttatgaaataacattttaaatgtgcttcaaaatatttccacagggcagtgtgtgtgtgtgtgtgtgtgtgtgtgtgtgtgtgtgtgtgtgaaaaataatcatacattttatttagagtcggtttcctttcacagaaaattttcattagctcttatgcatgaaaataaatagtcaaatgatttacagttttaaaatgtgacctgtaaattcaaaaatgtttaaaaatcattcagagttcctattataatagatttgtatgataattttaaaaaaaatttttttttgagagtttcactcttgttgcccaggctggaatgcaatggtacaatctcggctcactgcaacctccacctcccgggttcaagcgattctcctgcctcaccccctcactagctgggattacaggtgcctgccacaatgcctggctaattttttgtatttttagtagagattgggtttcaccattttggccaggctggtctcaaactcctgacctcaggtgatccgcccactttggccttccaaagtgttgggatgacaggcatgagccaccatgcctggcctgtttgataattttaaaaaatgttgttaccatccacattttactcaatttttataaaacttatcttttattttgtttttcagaataatttgttcaatttaggcttgtttcaaaacatatttatttaattttgcaattatatttcggtaaaggaaggaaaaagaacaatgagcattccagtgtgacaggagacatgtaactgcagtaaacaaacagctccatgatggtgacagagctaccgggtgtagaaggtacacattctaatagctatggttattcccattccacagatactgattaacgagtttcacaaaagatatgttgagaatgaattacttcagtggtagagtaagcagagatgaattacaaaagcttttagtaaatacagtcagccctctttatccgagttctgcatgtgtggattcaatcaactgcagataaaaaatattcagaaaaaaatgttctgaagttccaaaaagcaaaacttgccatgttctgagcactatgttgaatcaattccaatgaagtgatatatagaccttgcatgaggtataataagtaatctaaagatgatttaaagtatgtgagaggatgtgcatagcttacatgcacataccgcagcattttatataaggcacttaagcatcctcaggttttggtacctacaaggtgtcctggaaccaaaccccacaatgaataccaagagacaaatgtgtttttaaaacaaatgagaattggtcttgcagggtcctcaccaagtgaaagatcactccctgccttatggaggtgggagggaaataggaaaaattgtattaagtaaatgtctaccatgaagtcataaatacgatttgttcaaaatacttaacagtgaaatttatattttgaaaacatcatttaatattgaaaagaaaaattagggaacggctagtggaataaaaattacatagaagaatcaggacaatgaagtaaacttacataggggaaaagggaaatcaaaatcatttggggccaggcatggtggatcacacctgtaatcccaacactctgggaggcggaggtggaagtattgcttaagtccaggagttcaagactagcctgggcaacatactgagaccccatctctacaaaaaataaaacaattatcctggcatggtagcaggtatctatagtccaagctacttgtgaggctgatatgggaggatcagttgagcccagaaggttgagggtgtagtgagccatgaatcataccaccacatttcagcctgggcaacagagtgagactctgtctcaaaataaaaataaaaaaaatcatttgtaaaacataagtgaaatgaatttaaatacaagtttcaaatcagtatacatgaacgctaatacaattttcttgaactagagagactgtacaaggaaactgtgcatctggacattgctgtaatttttttttaacagggtcttgctctgtcccctaggctggagacaacctccacatcctggcttcaagggattctcatccatcagttttcagactagctgggattacaggcgtgggccaccacacccagctaatttcttgtatttttagtagagatggagttttcctatgttggccaggcttgtcttgaactccaggtctgaagtgatccacccatctcggcctcccaaagtgttaggattacaggcatgagccacggcatctggcctattgctgtaattattgatcataactgtggtcattaatgcatatatttttgttaagttgttttcttggtttaattcaatatggcttagggatatggactgcatatttcaaactttgtagaattctcttgagttttgttatgtggctgagaacattttatattgtacaggaaattcataacttttgggcaatgattttatcattccttgaagacttctgccctgctcctcttaaagggcacattgcctgctccatccactcctgagtgttcttttcacctggagtgacctgatctgcctgctctaggctttagaagggcagaggtaatgtgggtcatttctccacttctaccccaggctcttgagtgcatctcaatgtcaaggtttattaaacagaacaagaaaccgttcttcctttcccgaaataaattaattctccttttagatctcacaaataagtgagaacatgcaatgtgtgtctttctgtgcctggcttacttcacttaacatagtgacctccagttccatccatgttgttgcaaattaaaagatctcattattttttatagctgaatagtactccattgtgtataagtaccacattttctttatccatttatctgttgatggatacttaggttgcttcaaaatctcgactattgtgaaaagtgccacaacaaacatacgagtgcagatatctctttgatctcttttcctttattttgggtatatccccgggggatcgatggatcatatgatggctctgtttttagtttcttgaggaacctccaaaccattcttcatagtggttatactaatttacattctcaccaagagtgtacaatggttttcttttctccacatccttgccagcatttgttgttgccttttggatgtaagccattttaactggggtgagattatatctcattatagttttgatttgcatttcttttataatcaatgatgttgagcacccttttctatgcgtgtttgcaattcgtatgtcttctttggagaaatgtgcattcagatcttttgcccattttataattacattactagatttctagacagttgtttgagctccttatatactctggttattaatcccttgtcagatgggtagtttgcaaatattttctcccattctgtggattgtctattcatttcattgattgataagtttcctttgctgtgcagaagctttttaacttgatgggatcccatttgtccatttttgctctgttgtctgtgcttgtagggtattacttaagaaatctttgcccagaccaatgtcctggagacttttcccaatgttttcttgtagtactttcataatttgaggtattagatttaactctttaatccattttgatttgatttttgtatatggcaagagataggggtgtagtttcattcttctgcatgtgaatatccagttttcccagcacatttatagaagagactgtcttttccccaatgtatgtacttggcatctttgattgcaaatgagttaactgtaggtgtgtggatttcctttttgggtctttatgctgttccattggtctgtgtgtctgtttttgtgccagtatcctgctattttgtttatatagctctgtagtataatttgaagtcaattaatgtgattcctctagttgtggtttttgctaaagatagttttgtctattcagggtcttttatgggttgctataaattttaggattgttttttccatttctgtaaaaaatgtcattggtatattgatagggactgcattgaatctgtatactgctttagatagtatggacattttaagaatatttatttttcccattcatgaacatggaatatctttccatttttttgtttcctcttcaatttgtttgatcagtgttttatagtttttattgtagagatctttcacttctgaggttaagttaatacctgggtatttaatgttattcatggctatgataaatgagattacattttttcatattgttcactgttggcagatagaaatgcttctgacttttaaatgttaattttgtatcctgcaactttactgaatttgttcatcagttccaagaggttttggtaacgtctttaggtttttccaaatataaggtgatatcatccacaaacaagaataattttactttttccattccaatttggatgccctttatttcattctcttgtctaattgctccagctaagacttccagtgctatattgaataatagtagagaaagtggacatctttgtcataatctagaccttagaggaaagggttttagtttttccctattcagtatactagctgtgtgtctgtcatatatagcttttattatgttgagttatgctccttctatcttcagttttttaatggtttttatcatgaagggatgttgcattttatcaagtgcttttttttaacatcaatttaaatgatcatatggcttttatccttcatctgttaatatgattcatcacattgataaatttgcctatgttgaaccatccttgcatctcagggataaatcccacttggtcatgatgagtgatctttctagtgtattgcatgccaattgtattctccagctctagaatttctgcttgattctttttaatgttttcaatctctttgttaaatttatctgatagacttctgaatgccctctctgtgttagcttggatttccctgagtttcctcaaaacagctactttgaattccctgtctgaaaggtcacatatctctgtttctccaggattgttccctgttggctatttagtttatttggtaaggtcatgtttttttgaatggtgttgatgatagtagatgtttagtgtctgggcattgaagagttacgtatttattgtagtcttcactatctgggctttttgtacacatcctacttgggaaggcattcaagatattcaaaagtacatgtgtgttgtgatctaagctgtgtctaccttagggggcacactaagcccagtaattctgtagttcttgagactcattgaggtaccgccttgatattcttgaacaagatctggatgaattctacagattaccagacaaagattcttgttctcttcccttactttctcccaaacaaatgaaatctttgtctgtgttctgagccacttggagataagagtggagttatacaagcaccaccgtggcaaccaccactaaaagtgccctggttcaggcctgcagctagcacaacactgaatctcagccacggcctgctgtaaccacttcctgactaccactcatgtttgctcagggcactgcagctctaaaatcagcaggtgacaaagccagccaggcctgtatctttctcttcggggtatcaaggtcccgtaggccccaggaaggtccagaggtgacatctgggagccagggacaaaagtaaaaaaccttagaaatctacccgatattctgttgtattgcagctgagctggcactcaaaccacaagatactgtctttcccactctccccttccctttcaaaagcagaggagcctcaccctatggccacggccagcacatgcccatgggaagtgttgccagtctactgctgatgttccctcaaggcccaagcgctcttcagtcagcttgtggggaaggctccttggcttgggactcatccttcaggacagtgggctcccctctggcccagggaaggaccagaaatgctgcccaagagccaagtccgagaattgaggaaaccaagagcccacttggtgctctaccctcctaaggccttgctaatacctaaagtccaagacgaagtcccgtttactctttcctccactttttttttttaaagcagaaggagtttcaccccatagccaccacatgtgggaatgtgctgagtctcatctgtgagccagtaatctcagaggctcacctaaggtcctcaacgtggtacctgggtatcactgctggttattcagggctcaagggcccttcagttagcaggtgatgaatgcttccaggattgggttcttcccttcataataacaggttcccttttggcccaaggagtgtctagaaatgtccacaatctggggcctggagctagggggtggagcaatgattagatcaatgatgaaattctcaaagctttggcacagtggtactgattagttgtagcgatttctgatgactctgattggtgccctctcctgctgtggctgagctgattccaagatgcaagaaaaagtcctcactctttcttatcttctcaagtggagggaaggggttttttaggagccacaaactgtgcagcctggggctaggggaggggttccagcacccccttacttgctctggctggtgtctcagtaggttgtgtccccccatagtccacaggctctgggccaggtcagcacttggactcatttaggagttgtggtcattgtggcctggtttctttttctcatgtttcttttaaggccccagagcactttagtccatggtggaaaggcttgcaggaactcaagttcagacggctgggattggtaattgccctcgggctagtctaaatgctccctccatggatgggcatcagctgagtttggtccagctttgttttctgctccagcagagcagcgctgagttcaatgactcacgattgctgtgctctccctctccccagagcacagaattgctctctgcaccatgctgatgctgctggggaatgaggcaagggtgcatttgcaattcacaattgtttttctatctcttcagtgcttctttcagcaatataaagttaaggccaggtacagtgagtgctcacctgatttttgtttgtataaaggtgctttttgtgtgtaggcagttattaaattggtgtccttgcagtgggaacaattgggggagccttctattctgccgtcttgttcctcctccttccaaattttgattcctttaaaataacataactgagcttattatgcctgtcatgattctcttttgtacatataaagtgtttccagttatggctacctaatattgtcattgtctatgtttgcattttttactttacaactcatatcctctctttctctatatacacacacacataaatatatatttatgtacatataaatatttgttacatttatatatatgtgtgtatgtgctaaaactaagatgtaggcattttcacatgagtagtatcccttaaaaaaaactaatagaagttgccatgtatatgaataaggaaatctgaggtggatggtggaaggcgcagagagaggcaatctgaaatggaaaagagtcaagaatccattaaacctttaagtcacattgtttccttttcttggaactaacattgacacaaactattttacatgctgtttcgttttctttaggttttacgattaaacacatttaaagcccagttgatatctctacagttaaaaattgaatgtgtatgttatgatgtgtcacaagataagtagcaaaatataactaacaaaacttagcaggcaaaaaaatagaatgttggaaaacagcacatatgcacgtgttaatttcatcttttaaaccaggcatagatttatcatttaaagttgatacatcggtaatacaatataatttacattcatatatattactatgagaagactaaacaaaaatgattcataaccgtacaccttatgcatcaagagaatgcaaccaggccggtcacagtggctcacgcctataatgccagcagtttcgggggccgaggcaggcaggtcgcctgagctcaggagaatgagagccacccatcgagtataaagtgattttcatcaacttcatctcttatcatgtgttcaaaagggttttgtagcaatagtttccataagttggatttttacactaacctgttcatcaagagcctgcctgatatattttcttaaaagattgtttggtacctttactgaattggcaattaaaagtttttcttagtgacatttagtaaatgagtgatgtttattgggaagctgcttaatgcaagagaaaaatgaaaagattagatcatgactattgttaaagtgagaaattaaatgaccacataaaaaacttctcttctcttccttgggtatttttccaatattactcatttgccctctagggaaacaaacaacagagttttgtgatgaaacatgcattaaacagctgttctcaagctgttaattaaaaacaaaacaaacaaacaaactgcagaggaggcagcccaggcatttgttgtggaacacattctctgcttgccacttacatgttttgagtacagttttcagtacccatcagaaccagtttagttgatattccttctggattattagaaggagttttctccatgagaaatctcaggatgtttatgatgtcacatactagattacttaaactcttccctctttggttcctggagctgtgtgcacagtgctgaagtatgacatccatgccttcagttaagtggtcatcttcaaatacctctaactggcactctctttttttttttgaagcttttgccttttaacctggatctcctctcatcttttcaaggaaagatactaatatgaagacagaaaaaaagaagatcaagaaggttcccttttatctcttgtttctaaggtctcacctcttgtgaagttgtttgtaaacaattttgtctttacctaatattcctctctctggatatattatacctgtaagtgatccactatcatcaacttatatctccatactcacagtaagaaagccatttggctctcttagataatgtgtgtgagtaggagaaaaacaaatagggaagttcactcatttaagataattcagatattttgtgcatgttcagttcccacaaatgtgatatcttctaagttacagggaattaggtaagatgatcaaaataattaaatcgaatgggattggaaggtaggaattttggtggaggtatgagtaattggcatgtttactttaagaagatttgattgaaggaaatgaattaagcataatccaggagtacagaggtaaatacttttaactgaactaacaaaggaaagactagacaaaaacttagttgtcaaaactaaaaacataggttactgttgaactgttcctgaatactgtcaaactcttcatttagcacacttaaaaatacatttttcagggaaaagtggaacttttacaattaaatggagtcaccagttgggcatcaataaccatggaaacacttgaggaaggctgtacattttctgttgtttcatctataaaatacccactcatgtatgtatttaatttttttaatttttaaatttttttcaacttttattttagattcaggtggtacatgtgcaggtttgttagctggtaatattttgtgacggtgaggtttggggtgtaaatgatcccatcatacaggcacctagcatatacccaatagttagtttttgatccttgcccctctatcttccttctagcagtctctattttctgttgttgccatctttatgtctatgagtatataaatgttgagctcttattcataagtgccactcacttatttaaaacaaacatcactttcttgaaaaaatgtttaaaaatggtcaactaccctgatagcattttgatagattcagtcactcttttgtgaacttattttattgattgctttttgtgacccattttggacacactaagagacagtatctgaaagacaggaacattcttgctatcgtgtgatggttggttggtcagatgttgtcagtctggctatgttgaaagcacgggcataacacttcctgtgaggttagaagggaccaagtggcctacatattcctattgccttctggactgcgtcattagcttgctttcttttccaaagatcagttttatttgcatttaagtggtcttcaaagttagccacttgtcacaatgcaatatcatagaagatatcaaagcaaatcttctgtcatttgtgctctcaaattattagtatgagtttgaaatgggaaaagataaagtgttctaggagtaatcaattgatgtatagaccacctaatacatacaaggctgtgctaatggctgttgatataaggactatttagaggatgactctaccctcaaagagctcatattatatttgaggaggcagaagcatgcagcaaataaaaacaacaaagagagttgtagaaacaagttgaagaggtgtcatgagggcaagggcagcatggggctcgcccctgtcagagcgcgtcacagaaagactcaagatgtcttcattaaactctggtaaccatccgagtgtggtccatcttatttggaaaggcatgaaatacaaagttcatagtatgtgatgagtaaaataaataatcagattcacggatgctctggtaaagtgtattcctgattcttcaatctccattcagttcagcaaaatctcctgattgctctaccttgagcttcatttctgcctttgggcgcatttttttcctatcccaacccaaaactttccaggctgactacacgtgattataatttatctatgcacatatatgtttgtaaacaggcagtgctatgtttcctacttaaaaatatattatgtatatctttacatgaaaagacaactaagctacaccattatcaatgagtataatgtaaattgagcaatgtttgatttagtcaacccattaatgttgatcattaagattgtttctagtttattttcacaatcaatggcaataatttatttaatgtcttcatatattattcccacttcatactatttatttcctcagaataaactgatgaaaatggctaaaagatggattttttaagtttgctaaatgccagacgcttacagaaaaaaatggtttcaatttgtacttacactagcagtgtgtgatgttccccgcttcttcacaataaaaatcctaatttattgtcattactttagcattttttcagaatacaaacaacataccttttcattaaagagactcaaacatcataaaaaagttttcataaagaaatgtatttatttcttgtacttaagtttttgagccacttgatctggagtgtgcgttttaaagtcttactctttacctctaagttgcaattttgttttcttcatatatataaactctacctttcccagttatccgaattctcatcttacttgtgtgaaacatttgcgcatatgtgggtttttttgtattttggcgggagacagcagtgtttatttccagatactcttccgtttagttgttgagccttgttttttctattcagttactcatcctttacatttcacactggtcctacagaggtcaaagtcaatttttagcattgtttttccccagacaattcatatgtgtttgtcctttcagatcaaatttataatcattttgacaaattcctctagaataattttctattgctttttaaattaatactgaattatttagttttataaatgttctccaaaagtttagcatattaccagttattttaccatttttattgttattatatagaaattttttttgtgtctgggtgcggtagctcatgtctgtaatcccaatactttgggagaccaagacaggaagatttcttcaggccagaagttcaagaccagcctggacaacatggcaagaccctgtttctacaaaaaatacaaaaacataagctggatatggtggtctgtgcctatagtcccagctacgcaggaggctgaggtaggacaattgcttgagcccaaaaggttgaggctacaatgagcagtgatcgtgccactgtgctccagcccgaggaacagagcaagttcctgtctcaaaaaggaaaagaaaaagaaaaagaaatatttttgttgatatgttgttgatattatgagtaactacttgttcatatatgctggggcatttgacattgttattaaaaccataggggattcctgcaagaagtataagtgacctgagacctgggtctacagtaaccagatgaagagagaattgtgctccaggcagagagagctcctgagtcaggctattttctgggagagaggtgccaggaattgacagagtgctgcagagtagagagctgagtatccaggtcacttagggacatacaaaccacaatcaaaacttgatctttagctcacaaacaaccaagaatctttgaagggggatagaatgggaaaagagggagtttatatgaacaggtttgaagatgtgttgttattaatatacttctgagttcaataattaatattcatttgggaaatatttatatatgtgaacttggtttataattatgagagttttctgtcttttgaaggctatatatatttataaaataaatgattaattaattccatttttttgtgtacaaagatttttaaattttctgtccttagaagatttttatgggatgttttctgaactaggaattttgggaaagcagaattccattaaaacttttaaattgttccaaatttagagatcttctttggtattttcttttttttgatttatttttatcatactttaagttctagggtacatgtgcacaacgtgcaggtttattacatatttatacatgtgccatgttggtgtgctgcacccgttaactcgtcatttacattgggtatatctcctaatgctgtccctccccccacctatatgtgtgtgtatgcattatatctacttataattatatatgaatattaagaattttaactgtatgtgtgtatgtattatatctacttataattatatatgcatattaagaattttgactatatttgtgtgtatgcattatatctacttataactatatatgcatattatgtgtatgcatgcactcatacaaaactatactttaaaatcgtcttcttcattaaaatttcaaactatattaatataatgttaaaataacttctcatactataaatattttatcactcttctcatatctgtagttggatcatttttcttacttttaatgatgttttgtgtcatcctttctgccctcaaatatcattagcatggccagaaataggtctattttgtttcagttttaaagaatcaactttaaatattcagtctgcttattttaaaatccattaatatctatttaagtcttttatatggtctttctcttatttaaatgtattttgcagatatttttctaatgtattgggttgaatctttattaacatcacatattttttctataagaattacattattagaggttataaaattttgtctggatacatctttagctatatcctataggcttccatacataatatatttaatttaatgaaagtttgaacttcctttggtctaagtagtgttttaggcatacgttaaagtatttcaaattctctgatttagatgtgaacctattattatgattttagaattctaatatattttagtaaaaaaaaaaaaagagattgtcctatggaagctaactgaatatattaagcacataatgcatttccatttaaaatccaaattacagaattgttctctttgttccatttataatatcacctcatattgtagtttatatatactatgtcattcctttttgcatttttttagttttcttttccattttgtacattttgttttgttttctttgaagagtaaatctacactttgaaagcggatgtttactctgaatgatgttgtagccatgattaacctagttgtttctatctcatttcatcatatgcttcgcgttaatttcctgtgctgttatgcctttttttctttcattattttaaaccattttaatagacacccaaacacacatgtacacacatacaaacattcttttaactcattttaataccagtaactgatttggttaatctttttcaaaattgttcttattcttatagttgcctctgtgttggagtcataggctccagaaaaaaaaaatgtatttttttttctggctcatttacttagaaaaaatgttagattcttcataattgtatatgtttttatttataatcagccctttgccctgtatgttccaagaaagagggaatattgttaatggtatcttctgctcctagaaaaatgtctagtgaatactggatcacaataaatacttgaatgtataaatacataaatgaatgaaagctgctttctggtacttcttaattttacattctatttaaatagaatttgttttgcatgtatagtattagcattccattttcagaccctgttttctgtatagacagagataggtatgtctgtgtctacagattagatgtcatagatatatatgtatctatctatttctacatatatatgtctttgttgataagaatcttttgagttctatgcaataaggcaatcatatttacattatttttaaatatatatatatttaacctgaattcaacgtttactgttagtaatattacagtttcttcccttttcttaattttgtttcatctacaaaaatattcagctgtatcttactgtttatcccccctaatttatctcagaatgtcttcctgtttgagccacacattactctcaactaaaatgtatctaatgatatcgataataagttttactgaacagatagcacattctagatactagtctaagaaactgatgtgtgtgaatgatgtaaactttgaaacttgggccctttctattattacagagcaaatgggggaaatggatacaaaagtaatttcagtatccgtggccacacaatttggtggtggagaaagggtcaaacccaaggaaattctggctccagagctctctctttttactgcaacattgtatatcttcagtttagacattttttcacttttatttggaatttatcaggaagacacctgtggtcagtgtgaattttagcctgtgtaggtgactgtgttttccttttcttgtgttttgtttgcatgcaactatgtttttattagatgctgccagatgcttttacttcaaataactttcccagacacacacagtgtatttattaatgaaatgaaacatccatatacagagtctttttgttcctttcccaagttttccttttcaatttttattaataattctctcctatttgtgaaatcactctttttaaaacactgattatttatattttgcttttgtaattccaatactccatgtctacctttctttctttctttttttttttttttagatggagacttgctttgttgcccaggctggagttcaatggtgcaatctcagctcactgcaacccctgcctccctggttcaagcgatcctcccacctcagcctccagagtagctgggactacaggcacccgccatcatgcctggctaacttttgtagagacagggtttcaccatgttggccaggctggtcttgaactcctgacctcaggtgatccacccactttggcctcccaaaatgctgggattacaggggtgagccaccgtgcccggcccatgtctatctttcttaccatttaatatctgcctttctgcatcctggagagctactcaagttttatcctccacaaccctaacaaaattttatgtcttcagcgctcttctttgcagcctttcttgtaacgtctcatcctggaactgtttttaattgtcatgggtaaagcaccgcacttgcctgagtgtgttcaccctctcctgaagtgtttcctagtgttatcatcatggagaaagcactgcactagcctgagtgtgctcatcctatcctaatgtgtttcctagtgttatcatcatggagaaagcactgcactagcctgagtgtgctcatcctatcctggtgtgtttcctagtgttatcatcatggagaaagcactgcactagcctgagtgtgttcatcctatcctgaagtgtatcctagtgttatcatcatggagaaagcactgcactagcctgagtgtgctcatcctatcctgatgtgtttcctaatgttattgtcatgggtaaagcactgcactagcctgagtgtgctcatcctatcctgatgtgtttcctagtgttatcgtcatggagaaagcactgcactagcctgagtgtgctcatcctatcctgaagtgtttcctagtgttatcatcatggagaaagcactgcactagcctgagtgtgctcatcctatcctgatgtgtttcctagtgttatcatcatggagaaagcactgcactagcctgagtgtgctcatcctctcctgaagtgtttcctaatgttattgtcatgggtaaagcactgcactagcctgagtgtgctcatcctatcctgaagtgtttcctaatgttattgtcatgggtaaagcactgcactagcctgagtgtgctcatcctatcctgatgtgtttcctagtgttatcgtcatggagaaagcactgcactagcctgagtgtgctcatcctatcctgaagtgtttcctagtgttatcatcatggagaaagcactgcactagcctgagtgtgctcatcctatcctgatgtgtttcctagtgttatcatcatggagaaagcactgcactagcctgagtgtgctcatcctctcctgaagtgtttcctaatgttattgtcatgggtaaagcactgcactagcctgagtgtgctcatcctatcctgaagtgtttcctagtgttatcatcatggagaaagcactgcactagcctgagtgtgttcatcctatcctgaagtgtttcctagtgttatcatcatgggtaaagcactgcactagcctgagtgtgctcatcctatcctgatgtgtttcctagtgttattgtcatgggtaaagcactgcactagcctgagtgtgctcatcctatcctgaagtgtttcctagtgttatcatcatggagaaagcactgcactagcctgagtgtgctcatcctctcctgaagtgtttcctaatgttattgtcatgggtaaagcactgcactagcctgagtgtgctcatcctatcctgatgtgtttcctagtgttatcatcatggagaaagcactgcactagcctgagtgtgctcatcctatcctggtgtgtttcctagtgttatcatcatggagaaagcactgcactagcctgagtgtgctcatcctctcctgaagtgtttcctaatgttattgtcatgggtaaagcactgcactaccctgagtgtgctcatcctatcctgatgtgtttcctagtgttatcatcatggagaaagcactgcactagcctgagtgtgctcatcctatcctgaagtgtttcctagtgttatcatcatggagaaagcactgcactagcctgagtgtgttcatcctctcctgaagtgctccctaatgttatcgtctgtttctgctcccattgacattgcgggaagctccttctgattcatcaggtcctcacgaggagctcgttagatgagatgctacccattagatggaggatctgcattttgggtggacagtggacagaataaatcttcagcccgtttttcccctcaccacctgatccactcagcctcttctaaaccggtaagcaaaactgtgcagttatgtttgaatttttgttgaaagagaaggaaaaacttagaaaggaaaagtttcgatttcttgttagctagcatttttccttgtgtctgtgtatttctcactttcctaaatgaagtctcctgttcactgtgctgagaacactccttcaagaacctcctttgttggtctacttgcaaaactctaccctttttctccataatttcttggctaggggagggtaagaatggggaaagcagagaagcagaccctgctgcagagaaaatctggcacagagacacacagccaatcctttttctgagtggttcacgccatgagagaccttgtacatgtgctggccaaaaccgaagaggcttttctctactgaggagtcgctagggttcatctttttctagtactcaagatttttaattttcagtatagataaaaaattgaatcgtttctgtggtttcgtgagcatgtactgagaagtttgaaacaggccaccctggagaatatgtagacacttgcaaattattttttaggccctgttgttcatgtaatgctattacctaacatcttgatagtcactgtttaatctgagagtgaacttaggaaatgacagtcttcttcctggaatcagttttcccagaaactagtcttttacgagtccatatcttttgctaaaagattcctctaatggcaattatttgcatgatcaggaagaatgttctgagattttatcattttaaataactcacaagacaatgcacaagcctgcagccctgcctagttagtgttcaacaggtgacacataattttagagtgtgtcccctagtgctcaacaggtgacacgtgctttttagagtgtgtctcctattgtttgtgcctgtggtatacacacagtagctaagaaatgcaatattgccttcggcaagatattgtgtgtcctcattatcagcattctctcacaagcgcaacagcttatcatagattagcatttgaatttactcagctgtggtcctttgcatatgttacatgacgtttgatcatgacaacatcccgtaagtttcctgtgatatcctaattatagatcaggaaacgggctctaagtttttaagtaatgtgcattagggcacattgcaaatgatgaagccagaaccccaaacaagcattctcagtgcaagtatttcagaattgagcaaccccctactccaaaacggtgttctggaagctggctgccggctctgtgcacttactgctacatcatctgcctctctgtctggtgtaacacctgagtgcacacagaagggtccaagaattcgaaattcaagttggatttcaaagagtgttaaacctgatgaggaaacttttaaaagatattcttatattcatcgtgtattcaagatgtgaatgcaccacccatagctatctaagattgtgtatggtttcctgcctctggcctacaagatcttttatgcatttccttcagtcaccatctccaaggcttacgactgaccaaccaaatcaggaagttttgagtgaaatgaggaggacattaggacagaaagcacaacctggtctatcccagtctaagccttcaagacccacaaaaatacaacactaagcaaaaacaaaaaatgactcaaatgtaccaaagagataaaaagaaaaaaacagaaagatcataatgaacatgttaaagttaaactgttacatgttacaaactgcaactcaattctactgataacacttagaaaataattctgttctctttaccccggcctgcataccttgaagaactgatcactaatatctcactgtcttcatcacttgcaattctcttcctgaactgacttttgtttcctgactatcccaaactcctttttgctttagggatgtcacatttgctatttattttgtaggaacaccctagccctaaatcttcacatgaattttcttttatctttcattgtctgtgttgaagttttccgcaaagcccttatttgcattacctggaaccatggttcccacttttgatttactgtgcttatttcataactagaatgtaagtcacatgattcatattctttttatttactacagtatccccagagcttagaacactgcacagtactctctccataaataaagattaagtgtgcaaatggatgagaaattgacaaatggtgagggaacacataagaatgaccaatgatcaggcagataatgtaatcatgtttattacagttcaacatagttttcagttgtgtctacaatttatggttatttctggatgagaccaataggttttaaaattatcacagaaattcccaatttgagccaatggcctattgaattattttattgggttgtttgaattgattggatcaatagtctttcagttgtatccacattttaagtaaatggagccaactccaaatgaaggatcctctctagggcccagattttcttcaatcataatgaaactcccttaagccaagtatcaattgccaaacattcattcatcttcatcccatggggtcctaatgttgaaattattcttcatcaaaaagaaatagccaagaaaaaggaagctacaaatctaccacaccaaaaaaagttttatattagctacataaaagattttaatctaataatgtttacacagacatgtttaagtgatttatcttttgtcattttcattgaccctgcttctcttcttatgcctccatttcaaactcagtaccatgaatgaaaacaatgaaaccttgaccagaggctttaccctcatggggctcttcactcacaataaatgctcaggattctttttcggtgtcatttgtgccgtcttcttcatggccatgatagctaatggggtcatgatcttcctgattaacatagaccctcatctccacacccccatgtacttcctcctcagccacctctccgtcattgacacattatacatctccaccattgtgcccaagatgctggtagattatctcatgggcgaggggaccatctctttcatcgcctgcactgctcagtgctttctctacatgggctttatgggggctgaattcttcctgctggggctcatggcctatgaccgctacgtggccatctgcaacccactgcgctatcctgtcctcatcagctggcgggtctgctggatgatcctggccagctcttggttcggtggggctttggacagttttctcctcacccccattaccatgagtctcccgttctgtgcctctcaccaaatcaatcactttttctgtgaggcacccaccatgctgaggctggcctgtggggacaaaaccacctatgaaacagtgatgtatgtgtgctgcgttgcaatgctgctgatccccttctcggtggtgactgcatcctacaccaggattctcatcacagtgcatcagatgacatcggctgaagggaggaagaaggcctttgccacctgctcttcacacatgatggtggtgacattgttctatggggctgccttgtatacgtatacgcttccccaatcttaccacaccccaatcaaagataaggtcttctctgccttttataccatcctcacacccttattaaaccctctcatctacagtctgaggaacagggatgtgatgggtgccttgaagagagttgtggcaagatgttaggggacatgtggtgtgatgaggaaagaattctgatggtctaaaacctccacatcctgttcaggcatatatggggtcgtatcatggataccacggatgatgctgacaggaactttcaataccagctgtgctaaatggtgtatcaacagtacccccatcaaaaatgggaagttgctgtaacagtcacacacaaataatgccagagttctagaaacaccactcatgtttattcttcttttgtttctactgattccaagtcttctctcatatcacttctctgattgcagtttgtgtatatgaatgccccaaaatgttgagttaatattacatattctgcccattttcaatggctccataagaactggtgattttgactatattgtttaaacaatccatcaattggcttgtcaaagatttagggatgccaaggtttgaaagacatatgaaagagactaaactgtcataaaactgtaaaagaaaaatctacatagacttacaccaagatttagaaaatccaaatatctcttctttgagtaaccactgaaaacactcctcctttatctacatttggagctaaaaaaaaatgaatcatgtgttttgtagaaatgccaagactaaatctttatgggggagggagtctgtaatgttagttttttaatatggtaactaactgttacattggaagacacagcaaaaggtagttgagaaagaaatgccctattaactagcagtttctgtaatcactttacagcttcttctccaattcactagcatttttaaacttttgggatccctgtgcagatgttagtgttgttggagctatttctaccaacttttctcttttaaaaaagtagtagacagcgtcatatttttccttctctatagcactggcttttgcattggatagcattgcaaagtgggaaggaaatacccagcttttcatgtgaaaattagaactggaaacccttgtaaatgacttagtgtcatgagcggtgcaaagttagaaataaccaggaccacaaatgcttgtgtctttccacaatgtcaggattttattgatgctgtttcaatcacaaaagccaccatgagctacatagagttcccaagggggcaactctccttagtacttttcattcacttggtagtcagcgttgtgggcacacagactcaagccactccacaagtcagtcaatattgcaaaccatacataatagtatacttaatcaatatgtaaatgttataggtttaacatttcacaacaaacaaactaacatttaacacaagaaggaaaagggataggagaaaggatcacaaaccagtccaaggggagagaagaagagaaaagcggtcctggtccaggccgggtggtccactggtcttgcaagaaagagtctctgaggtggcagagacttcagcagcagatgccaagttttcatcaccagtgactgcaagatggcatcagttaacatggctatttcgagctgctgaaggcctgctcttttacggttacagagtcctcccatgagaactgatcatggaagagtgtgcttgtttgagtccttatctggttggatacagtcttttattttttaatttgtttagtagacaacacatcttatccttgttggaaaagtgctctatgaaatataaaataaagtctttttctaagatggagttggctacgtcaagggtgttctatacacttagtatgatttctttttaagtggctaagaactggagaaaaaatgtttggcctaaactgtagacacagtagtaaaaaccaggaccacatcccaaacccctcaggccacctctacaagctgctgtgccaggctttgtactgtcattggtttaacaaaatccaagccgggttcagtgacgttctgcagcgactgaagatggtgggtgaatgaaagatagccacacctccttttgtactgaaaaaagctgctgggtatttgacaaaatatttagccaaatagaacagctcaacttggcattgggctgagcacttaatcaagaaaatagaccaggtcttgcctaacagagcagggttttcagttgaaatccaggaacagcttttccgaggctcttcagctggaggctcaacatctcctcaatcttgtcagactgtcttggacaacagtatgtgccagataatatgagggagcatttccaaccaagaagatgttgaggtacaaaaaacacaacaaatcagaagagaaggagagggctggcccataagaactgatcatcagtttcagctccacgtaaacaccatgtgaatttctgtcaatcatacaatgcttctgaggaccaactttcttttttataaaatttgacttaatacatactttttttcttgtaagattttaaaatcaagtaaaatgatgaatgtaataaaaccttataaatgctagtcattatttcagctattctttgaaaagatgattgacttttatattcagtttttacaatttctttcatttctatcgatccgttacagacaaaagcacactctcttgtacagccactttggaatacagtttgacagtttcttacaatattgaacataatcttatcatatgatctggcaattgtgtttcttggtgttaactctgctgatttggaaacttatgttcacagtagatttttcatacattccaaaacatagacttaatcagaaagtccttcagaaattaaatggataaagtgtggcacatgcatacagtggaatattatttagtgttaaaaataaatgatttatcaagccattggaagacatggaggaaatttaaatgtatattgtgaagtgaaagaagccaatctgaaaaggctgcatactgtgtgattccagctgcatgacatcctggaaaaaacaaaactgtggatacaggaaaaagataagtgttgcaaggggtctgggggaagtatggatggatggacagagcacagaggacttttagagcagtgaaactattgtatatgacacagtaattaatgttacataagattatgctacatggtactatgtatttgtggaaaaaaacatacaactctggaacagaaagactcatccttatgtaaaatatgaactattaataataatgtatcaaaattgattcatctattgtaacaaatgtactacactaatgccagatgttaacaatagggaaaagagaggggatatataaaaactttctgaactatccattcaattttttggtaaacctcattgttctaaaatataaaatttcattttaaaacagttttctaacaattatataactctctgatactatatttcttgattggatttcagtcaataaatcattaggagttctcatcaaagaattgtggtgtttgtagaagttaggatgggggatggggatgaaataataaaagtttgttaatctaattggtcttgttttgggagtttggttatatgttgttttgaagacgcgggagcagtgaggctaatatttcctggaaagttagaagaacatgggccaaatattaattagttttatgcttggggcatatggtaggagcccctcattccaagttagcattccttccctgttctgcatatataagaaaatactggaaatgcatcatctgtatatggaagagggggggaaatgtctatattacctcacaccagaaaaccaaaacctattaaaagagggatgctgcttcaggagaaggcctttttagagtgagtgaattttttttaaagaatttgattattcatgacccatcattgggaatttcatctcgagttcagatattcagcctttgatggaatgtgaagccacttgtgggccatttggccatccctgcaggaaaatcagttcaaaactcagcctgactctgcgggaaacctcttagaaacatgtgcttcccctggttggaaccagctagcaaaatgcataatttgtgctcaaagaagaattagtaatggctagaagagagattaatttttcttttagctctcctagtaactcagtctaccatttggatgactctgttgccttagcctgagtttctacttaagtgaatagggaatactctcctagatatggttgttgattccctcagaacaaaattaacacggcaactatcaagtcatgcacaacccttttggaaacttgaggaagaacgtgagcaacatttctaaaggtttttgtcactattctgaaattcataatgtcataaatatatgtcattttattactagactttagaaatatgtaggcgttgtgtagcacagagtgatttttgatatgaattgatgttctcaagaagtcaatggttttacattaaaaaatgcaggactgtgcatgggaaggagtgtaggtggaatgattggggaccatagagcaacaggagtctggcgccttctaggacctatccagagatattcagcctgacaagcatcaggcattcacaatgatgctcaaatgaaatgtgaagaattattaatgcaggagaagaattcaaggtagttttgtcaaactgatgagtttttggtacatgctagttgcaaagatcactgctaggtttttggattgctgtgctgaggatttttctgaggtcacatgtaggccctgtgggaagagtgatgtaaactaattagccaggatggacacaggtgggtgcctcgggatgagttctaggacgtggggtgccacattggctgtagtcagctcttacccccaagtgccatctaatggtttatagcatagcagttgcacagcaagaagaaataaaaagcatctaaataaggaaaagaagaaggcaaactatgtctgtttgctgataatatgattcaataccccccaaaaaccaaaagactttgccaaaagattcctggaactgagaaacaacttcaagtaaagactcaggatacaaaattaatatacaaaattcagtgacatttctaaacaccaaaaacattcaagctgagatccaaatcaagaactcaattcaatttacaacagccacaaaaataaaaaatctaggaatgcagttagccacagaggtgaaagatctctgctaggagaaccacaaaacactgctgaaagaaagtaaataagactcaaacaaacagataaacattccatgctcactggttggaagaattaatctcattaaagtggcccaaggaaatctacagatttaatgttattcagaaaaaactacagactttatttttcacagaattagaggcaactattataaaattaagatgaaacaaaaaaagagaccaaaaagccaaagtaaccctaagcaaaaagaataatgctaaagatatcacaatacctggcttcaaactatactataatgttccagtaaccaaagcagatggtactggtataaaaacagacacatagaccaaattgaatcaaatagagaacaaataaataaagccacagacctccaccctgtttatctttgacaaagttgacaaaagcaagcaatggggaaaggactccctacctaataaatggtgctgtaatagctggatagccatatgcagaagaatgaaagtggacccctgcctttcactatatacaaaaattaaatcatgatgaaataaagatttaaatgtaataactcaaactaagaagcctagaaggaagcctacaaaaccccattctgaacattggccatgggaaataatgtatgactaaatcctcaaaagcaattgcaagcaaaacaaaaattgacaagagggacctaattaaactaaagagcttttgcacagcaaaagaaactatcaactgggtaagcaaacaacctatagaaagggataaaatagattttctagtttatttgcatagagatgtttatagtattctctgatggtagtttgtacttctgtgagatcagtggtgatattccctttatcatattttactgtgtctatttgattcttctctcttttcttctttattagtctgcctagcattctatctgttttgttaatcttttcaaaaaaccagctcctggattcactgaatttttgaagggattttttgtgtctctatctccttcaattctgctctgatcttagttatttcttgtcttctgctagcttttgaatttgtttgctcctgcttctctagttcttttaattgtgatgttagggtgtcaattttatatctttcccactttctcctgtgggcatttagtgctataaatttacctctaaacactgctttagctgtgttccagagattctggtacattgtgtctttgttcgcattggtttcaaataacttacttatttctgcctttatttcattaattacccagtggtcattcagaagcaggttgttcagtttccatgtggttgtgtggttttgagtgagttttgtaatcctgagttctaatctgattgcactgtggtctgagagactgttacgattttcattcttttgcatttgctgaggagtgttttacttccaattatgtggttgattttagagtaagtgttatgtggtgctgagaagaatgtatattctgttgatttggggtggagagttctgtaaatgtctattaggtctgcttggtccagagctaagtgcaagtcctgaatatccttgttaattttctatctcattgatctgtctaatattgacagtggggtgttaaagtctcccactattattgtgtgggagtttaagtctctttgtaggtctctaagaacttgctttatgaatcagagtgctcctgtattgggtgcatatatatttaggatggttagctctgcttattgcattgatccctttaccattatgtaatgtccttctttgtcttttttgatctttgttggtttgaagtctgtttaatcagagactaggattgtaaaccctgaattttttttttttttttttttttttgctttccatttgcttggtaaatcttcctccatccatttattttgagcctatgtatgtctttgcacatgagatgggtctcctgaatacagcacactgatgggtctttactctatccaatttgccagtctgggccttttaattggggcatttagcccatttacatttaaggttaatattgttatgtgtgaatttgatcctgtcattatgatgtaagctggttattttgcccattagttaatgcagtttcttcatagtgtcaatggcctttacatttttgtttgtttgggcagtggctggtacaggtttttctttttcatatttagtgcttccttcaggagctcttgtaaggccggcgtggtagtgacaaaatctctcagcatttgcttgtctgtaaaggattttatttctccttcacatatgaagcttagtttggctggatatgaaattctgggttgaaaattttttgatttaagaatgttgaatattgacccacactctcttctggtttgtagggtttctgcagagagatccactcctagtctgatgggcttccttttgtgggtaacccgatctttctctctggctgcccttaacattttttccttcatttcaaccttggagactctgacaattacatgtcttggggttgctcaatcatctaatctttgacaaatctgacagaaacaagcaatagagaaaggattccctatttaataaatggtgttaggaaaactagctagccatatgcagaaaattgaaactggatcccttccttacaccttatacaaaaattaactcaagatgaattacagatttaaatgtaagacctaaaaccataaaaaccttagaagaaaacctaggcaataccatttaggacataggcgtgagcaaacacttcatgactaaaacaccaaaaccaattgcaacaaaagcaaaaattgacaaatgggatctaattaaattaaagagcttctgcacagcaaaagaaactatcctgagagtgaacaggcaaccaatagaatgggagaaaatgtttgcaatctatccatctgacaaagggctaatatccagaatctacaaggaacttaaacaaatgtacaagagaaaaacaaacaaccccatcagaaagtgggcaaaggatatgaacggacacttttcaaaagaagacatttatatggccaacaaacatataataaaatgctcatcatcactggtcattagagaaatgcaaatcaaaaccactgtgagataccatctcacaccagttagaatggtaatcatcaaaaagtcaggacacaacagatgctggagaggatatggagaaataggaacacttttacactgttggtgggaatgtaaattagttcaaccattgtggaagacagtgtggcaattcctcaaggatctaggactagaaataccatttgacccagcaatctcattactgggtatatacccaaaggattataaatcattctactataaggacacatgcacacgtatgtttattgcagtactattcacaatagcaaagacttggaaccaacacaaatgcctgtcaatgtcagactagataaagaaaatgtggcagatatatgccatggaatactatgtagccatttaaaaaaatgagtcaatgtcctttgcagggacatggatgaagttggaaaccatcattctcagcacactaacacaggaacagaaaaccaaatgccacatgttcccactcataagtggaagttgaacaatgagaacatatgggcacagggagtggaacatcacacactggggcctgttgaagtgtggggggcaaggggagagagagcatcaggagaaatacttaatgtagatgatgggttgatgggtgcagcaaaccaccatggcatatgtatacttatgtaacaaacctgcacattctgcacatgtaccccagaacttaaagtataattttaaaaattcgtttaatccaaaaaagaaagggataaaatattcacaaactgtgtatgccaaaatggtctaagatctgcagtatataaggaacttaaataattcaacaagcaaaaacaaacaccgccattaaaaagtggccaataccatgaataaacacttctcaaaataacacatataattggccacaaacatgaaaaaatgttcaacatcactaatcatcatagaaatgcaaatcaaatcacaatgagataccatctcataccagtcaaaatggtcattattaaaaagccaaaaacaacagatgctgctgaggttgtggagaaaaggtaatgtttatacactgttggtgggaatgtaaatcaattcagccaatgtagaaaacagtttgtaggtttttcaaagaacttaaaacagagctaccatttgacccagtaatcccattactgggtatatacccaaagaaaaatagatcattatgccaaaaagacccatgtacttatatattcaacaccatgctattcacaatagcaagacatggaatcaacctagttgcccatcaatggtagattggataaagaaaatgtggcaaaaaaaaaaaaaaaaaagaaaatgtggcacatatacaccacgaaatactatgaagccattaaaaaagtatgaaatcctgtcctttgcagcaatatggatagagccagaagccatcatcccacgtgaattaccacaggaacagaaagccaaatactggatgttcctactcacagatgggagctaaacattgaacacctggccacaaagatggcaaccattacatcctagaggtgggaggaagggagggggtaggtgttgaaaaactgctgggtaccatgctcactacttgagtgatgggatcatttataatccaaacctcagcatcacacaatacactcaggcacatgtacgccatgaatctcaaataaagtggaatgaataaataaataaataaaatgattttttcaaaagaagttaaataaatgaatagtaaaaatataaaagttggccgagtgcagtggtgcatgcctgtaattcccacactttgggaggccaaggcatatggatcacctgaggtcaggagctcgaggccagcctgtccaacatggtgaaaccccatcactactgaaaatacaagattagccaggcgtggtggtgtatgcctgtagtcccagctactcgggaggctgagacaggaaaatcacttgaaccctggaggtggaggctgcagtgagccaagatcatgccactgcactccagcctgggcaagacagagtgagactcttgtctcaaaaaaaaaaaaaaaaaaagttgaagttaaaaaaattaattaacctttctaggaaaaacaacagaaaacattaaatctagtccttttacatcagaatttccagatctgtgtgtttgtgtttatttatttatagatagatgaaatgattgatatatagatgtgaattgataatataaaaaatgataatatttttgaggtgcaacttaacaaaatcaaaactttaaaaatattcacacaaatgaattaaataatattgactgaggaaaagtcgatgaagaaaacttccaaaatctatactcaaattagacataaggatttaatcagcacattattttttagtcccctgaattaaaactgtatgtatgttataaaaatggagcattaattaaataatattgagcatatccataaagtatagtactttgtggatagtgcatgctacgtttgggagaatatttcacatcggggcactttttatgttgtattttgtgaacaatgcaaattgtggaattacatgttaacccacagacactcatcacacacacatatatgttgttgtgtaaatgccatatctatttatagtgtttaagtttctgcatgtgtctctctgttggttctctacctcttgtttagttacataaagctcttgtagtttactggtacatacacacacatacccacgaacatacacacaaacaaacacatacagtataaatgcaattttgtaaggataatcatctctatgatgtgttttcgataaccctatctggtattatgtttttcccgatgggtatgcgttacctttatgctcaaataaaataataattattaaactaccaacaaacataacagatgttatgttattaaaatataatagaaataaagctactttttatctttttaatggctttccacatttgttcccacatttctctgtgaggaagagctgctggcagaactttctgatgaaacactcaggaaatcagttttacactttgaagcacaggagttgaaacatgttctcaaagcccatgtcacttaaatgttcactgttttccaccccatcaatacacttctcattagctgtaataagtccgtctcattaaagtctcctgagatccaaaaggaagaaacttgctctttcccagagcacttcattccatgtccctcaaagaaaactatttaaactcatgcctcttttcaatctgggcgctcccttgtcgctccagggatctcaaaagcagaacacccagaataattcggcactctttactggtctgctgctttcttcctgcatttttagtttttcagacctgtttagttgctaaatatttccctgtaaagataagaaatagacattattacatgtttctagaaggctggagaatttatgcaatttgtcctggcaatgcaaattgtttcaaggatttctaaggtggcatttatttgtttggcttaataatacttccttctgcagagttatattacaaaaatagctcctaataaacttgttgcatgtctctctttgtcctaactccatcatcagttgctaaggataccttcagtcatgccaagttcataaatccaaattagaaatctatgcatactggatcttcagggtaacatgctgacagcactttggcatccagatggcctagatgttgaaggatttcctgttgtgggtaccaatgactatgaattgctttgtgtgttttcttcttggtataagttagatgagaatttaagtctactaaatctaatcatttttccttctagcaaaatatcaccttcaaccttctaaaaagtcttagttcttcatcgcttgtttagttacataaagttgttgtagtttgccagtaagtttttgatttactaaattatacataaccttctctatctactactctgaatggctatcctgacagattcagctctctgtaagtgacagataatcatcttttgttggaatacagtttggaataaaattagatatttggataatttttatgaaaattatgtatattgtattccttgatgtctacttagtgatgtgtgtcacatgctgttttgagtgggtggcattcagattgcatggatgagaggagatatgagaaatgtgagaacatatagaacacatgaatacattactttatgaagctctttgaaaattaaataattggatttaatagttaaggttttgtctaaatgatgcaacatccctcagtaaaattaggcaattaaaatggatcatctaggagcttctgctgtacttagactcactttgtttgttccactcttcctattcccttaatgaaaatccaggtcttttggaattatgcaggaatttcacaggtaagaagtcaaatgctgatgagcacctagactgactcctcctcatagtagcactttaaatatttggtgcatatgcaaatgaccgggttgccagaacatttcattgtggtctgactgaatttacgttctttatatgacataaacaagatttacgtaaactggatctaagaaagttgaggcagagttgtctgcaactcctgggctggaaatctcaggcacaagtataatgaggaatgactgtcccattccctccatgccaaatgcaagtgcattgagaaaaagagtgcctgtctgattatctgtgggaattacatggagtgagtgttgtaaatctcaggtagaaggatgccattgagtgtaacagtgcaaagaatcttttcttaaatgtttgctgcttttcttaaaaaaataatttaagcaaactttagtcttatgaattagataggataaggacaatactgttcgaaaggcacaaaagatctaaaggaaaaacctgtacttactcctagtttctaaagtacagactatgaaccaggcttcctgaatctctgaacagtgcattgtctttatctccttcccctcgttttacagataagaacactgatgattggagagttgaagatgcttgcattaaagacacagagctgacgtaaggcagactcctacaggcattctaatttccaacatagactcgttgcctgactgtcaaacgtgcaagcattttaaaaatccttttttccacaatgatttcaaagaatgtgcagacacctggatttctcagatccactttgccagtgattcacaggcatttttttagtgtccatcacaccaagcataaaataaactctcatcagaaataacaggtctctctagtagaggggtttattctagtgtgtagtctctttatgggtcttgtaggaggtgtgtgtgggttgaagaatgtggttctaagttactctaaaattgtcagagtacattagtgctttattatctaataattgtatgattattatttcaatatgagttcattcttaatgattccaactttttgaaatactaaacagaatttaggaacacggagaaaaactaggaacatatatttttgtatttagtctcaaaattgcacagcactgtattgacctgtcttgagaacttctcatgtgaaaaggtaactgtaagtttgaatgtgtatgtaatgactcaatgtgtctgcgataacaacagaaaagtaatattgccagtgtattctgtacaggaaaaaccacacctacagtaatctgttgaaattgaggtattatattctaaaatagacattgcaaaagctatccccagtaaatacctggaagttgagcactttggaaaaaaattcatacatgaatgcataaaataactggagaagtgtgaccggtatagagaaggaggacagaaaaccttgtagtcatattcacattatgaaatgttgaatgttgcaaagagagaaaactggttccaagcagattcagaaggcaaggaagaatcctgcatgaagcagctttaatttaagctaatgcagagcttcctaacaaggctgctgcattgaaggagcatggagcttgctcttttctttggcagaaacttcaccagtggtcatagggaagcaagcaaaggctgcaacttacaagttaggaattatcttgtcacttgatttaaaggatgggcttggagatcatcacagtcctgggcaagcattgtgtcctaccttcaaactgtagtgatgtgggaggaaaatatttgcggccatccctactcaaccaacatgcacgccttataaaatagtacagaatatttacaaatgtcaggataacataaatgcattgatttatctcttggtgtacggtattatgcaataaaaaatagtttaggtaggcctaaaagacaattttatccaataaaattatgtctattttatccactaactttttaaaaataattttctcaaaatttgcaggccaagcatacttctgctcttcaaaggcatttagatgttctgcaagcttaattgaaatgcacagttttttctgagaatttctactaagtaacaatcctttcaagtcaaaggatacttgggggaaaagatagactttaactgctgatgtaacttcactgggagcacctgggtttacagaccttttctgaagatcaggaggtatttgcaatttaaattcatagattttagttgaatatgtagattgcttaaatgagagattgagaatttgcacccatttaccaatagttttgaaataatttgcagatatcttacattttacttggtattgtataaaatatttgcacctgtaactataaatttcttatttgattcttaaagtaaccctgaatgtttattatatcaattaatataagcagatactgaggctcagggtgtttaggaagataatccaaggtcacagaattaattaatgtcgtgaccagaggaagaactcaattcatttaattctaaattttgttttactgtatgttgccttcatcatttcagaaacaaatgcctatataaagtcacagaatcattccaaacattttctgattatttttatgtgtactaaaccatagcaaagctgtatgatctatgcccaggagatattcaacaagtatagttacttattgtgctcactctagtgagagagcagataataaatttaacaaaacattttacttaaaatcataatttactttgaggagggcttgttctctgataaattagatcttttgtatgcagataggaaaagtaaggccacttggctgcaaaatggagtagactttagaatttccctttgcattgctaggtttgcagggctagctggccatagaaaaagctagaaccacagaagagttacatatatacatatataaatctatgggaggaaattatgaatgtatatacttatatatatatatataatggataaaagatcatcctttatattcttgaagtttgttgtggattttactgtaacctgaaattgtataaaacagtccctcagtttttcttaattgccagagctacggaaaaattccaatttccaaaaatcatcggtgagttatacctcaatatgtatgtccctgtgctattacatatacgtgtgtgtgtgtgtgtataaaatgggagtaagggtgaacagacagcagagaccactgtttgactttgtgaagcagcacatgattttccctctgtttctggtgtcttatcgcatgataaaagtcaaaccgaaaatgtaggaagtgtggaagtagctgaaatactgctaatatttaggctgcgacataaactggagaggagtttccctttagaaatatatttttataggttccattaatgaaacctaaaaaaagtaaaatgagggaggttgtaagtaatgatgacattgtacatagtatcataaaaatgtataaaacctgacaccaaatattctgaattagcaaaatatacattatatatatatataaaatatacatatgatgtatctatgtgtacatttttatatatgtgtgtatatctgtacacatagtttatatccataaaacagcaatcctgattataataatttatgtgatctactctcaagtatgactaattttcattagtcacattagttattacattgttaacaatttagcaggttcacatgcttggtacattttatttgctaattacagtaaatgtctagctgctattcccatataaagcttcctatatacacaatgccatgtgtatgaatatataatgaattgagactatctagtccaaacactcctggcactaacagaccccgtgaccaccaacacgttaccctcaatgctgtcattggtgagaggggcttttatagctcctcacttcttagttttattgtgaagatcagggagtcaatagttacaaagtacttcttagcatgacactttgcaaaataaactccacgatgtcatcatcattattctcaatagcaacttctttttctgggcaattgactcaaatgctaatatttttagaatatttagaggagcactagactagtttgatcaattttactcccaaatatgttggtaaaatgtctttcttgggacacttttagccttaaacaatgtgaaaaatcatcctttacttccatgaagtttgttgtggatatttgtttctttattgtaacctgaaattgtataaaacacactcagtttttcttaattatgaagaactatgaaaaattctaatttccaaaaataatcagtgaattatagctcaatgtttacgtccctgtggtatttcctctgaatattaattgctaatactgatttctaatggtcatgctaatcataatcctaatgctaattcctcatcatcttaaaattgaaaataaataaaattctacaacactgaatgcctcttgtattgagaataatttttatgtctaaatttgcaagagtagtttccgttgagtttctgttgccctttttatttcatcccttataatttgtctgggacatggataaactaacaccaagtatactctcatgatgtagacagtgacttgtgacccaaatggtagataacccgtacttgtagctaaatggaagacatgagctactcacagccagcaccaaagatgttttgaaagtagtggtgatgccaaccatacaaagacacattaaataataatacaaatttaaatgcatctaaggtaatacacacacgcatacaccggaccatggtatgcgtaactgctgtgtagcatggtatgcaaccttaggcattgttatgcacatcatcgtaatacagtatcatctgctgacctcatcttctccaatgtatttaagcaattattgattaataatgaccaattttatttaaaaaccttctggaatagagtaaatgctagatatcagtctcaatgtggcaagaatactattttttaaatgttttcttcccacttttaaaagtttgctgcctaacaattaattcacatgttgttattttactgccctgggaatgctatcatcttatttggaagatattaccttatatcggcacaactgtaggatcaatggaagagtacaacacatcctctacagacttcactttcatggggctgttcaacagaaaggaaacctcaggtcttatttttgccatcatctctatcatcttcttcaccgcactgatggccaatggggttatgatcttcctgatccaaacagatttgcgccttcatacacccatgtacttcctcctcagccacctttccttaattgacatgatgtatatttccactattgtgcctaagatgctggttaattacctgctggatcaaaggaccatttcctttgtggggtgcacagctcaacacttcctctaccttacccttgtgggagctgaattcttcctgctgggcctcatggcctatgaccgctatgtggccatttgcaaccctctgagataccctgtcctcatgagccgccgggtctgttggatgattatagcaggttcctggtttgggggctctttggatggcttcctcctaacccccatcaccatgagctttcccttctgcaattcccgggagattaaccacttcttctgtgaggcaccagcagtcctgaagttggcatgtgcagacacagccctctacgagacagtgatgtatgtgtgctgtgttttgatgctgctgattcctttctctgtagtccttgcttcctatgcccgaatcctgactacagttcagtgcatgagctcagtggagggcaggaagaaggcatttgccacttgctcatcccacatgactgtggtgtccttgttctacggggctgccatgtacacctacatgctgccacattcttaccacaagccagcccaggacaaagtcctctctgtgttttacaccattctcacacccatgctgaaccccctcatctacagccttagaaacaaggatgtgactggagctctgaagagggccttggggaggttcaagggtcctcaaagggtgtcaggaggtgtcttttgacagtcgactccttcccatgcatatggtaaatgggggactctgtggtcactgtggctgtgctttcatcaaaagatgaagcaaaaagggagggagtcatatgattacaatattggttttttggctagggtttctggttcataactccatagttatgatgttgtggttttttaggcctcagaaaactgaatctctctctgtgatcttcgccttccctcttttcacctgcttctttttctccccaaagaaagccttagaaactaaaaatataatccaatctttccccgcttttggtcacaaagaaattatctgactaccttgtctgactgtatgtcataagacctctgtttcaaaagaggtcttctctcataccctgggggagggaatgctatacagagaggccaagaaaaatccgatcagacaggccttcgtgggtgtccccactcactctatcaacattaggtcatactctttgttcaatcatatttctgtgcaattgtccatgcttcaatcatgactattcaataaagtctccatataagggccaaaaggagaggacagaaaacttctggacagctaaactcatgaagctgaacaggagggtgataagaacccatccatgtgcctggagggtggcatgtcccaactccacagaggcagaagctcttatgctcttccagacctcaccctctgtgtcttttcatctgactgtttctgtgtatcctttgtaatatcatttataacaagtggtaaacataggtaagtgtttccttgaattctgtgagcctttatagtaaactaactgaacccaaggaagggccgtgggatccccaatttacaatcacttggtcaaaagtacaggacaacttggggcttttaattggcactggaaatggaaggcagtgttatgggactgagccctcaccctgtgggatctgacactatctccagatagatagtggcagatggtcatgggagtttagcttgggctagagcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagctagggctagagcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttggactagcgcatttgactgtagatagtggccgatggtcacgggagtttagcttgggctagcgcatttgactgtagatagtggcagatggtcataggagtttagcttgggctagcgcatttgactgtagatagtggccgaatggaattgatttggaggacaccaagtggtgtccactgcagaaatgattgtttacttcgtgtgtatcaaaaatcccccactcatttggtcccatacatcttatatgttggttgttgtgtggtgtggaagcagaggaaaaacagtttcatgtgtttttttcctcaaagagcgttcaacttggtgggaaaaaaaaactaatgtaaaaaaacgtcctcttgatctcttttccttctcttttctttttttcttataccttccgtttctcctgccatgttcacatgtattctaaataaatacaagagggctccataaacacaaaaatgtgtttccatctgcaagctggtagaaagagtcattgaacatagtcttcttaaacaggtattgtactcactacaatcaggtgcttattactttcagtaaaagtacggtatttatctttttttattttgcaacacattagtgaaaactatttgtcagataacttaaaataaatggatgaaagcaaaggacattgcccagaaaagacatcatgagaacactgcatatctgaggggtaacggggtttctaaaacactggagaaacatacagggggatgggttaggaaggcagtaaaatgcttttcaaatatctcatgagatcatcaagattaagcatatatcagccatgtaatagtattagggcatagttaatattcatgttccatatggatccaggaattgaggaaagaaagcatgtgccgatacatggttagtatcccaattatataaagagttcactcatcatcaaaagggtgactttctcaaaattataattcaccatgtggggttatcattatacaaacatcatcatggtcataatcataatcatattcatcaatctctatctaaaacttaaaaatttatgtgccttgccaggttcatcatcctttaacaacttcataacaaaggaagcagaacttgttatgagtcatagtttacatgtaagaacagtaagtttcagggaagcaagaaaattctgtaggataataattctaattaatagactagatggcagaatttcaagaaatgtgattgatagaacactatattcttcagatacagcttcctcattcattcattcatgctttatagctgtgaccaagacaaacaaagcaattgcacttgagaaatttgcattccagtgtggaaaagacaatgaacaaaaataaatacaacaagtgagcaagcaaaaaaacacatatatccaccatgttgtgtgtggtagctgtgactaaagctaaacatatccatatcctgcacccctgcaggtccattcttgagtgaattcttaatagatatattatagtttgaatttggtttattttgcccccaccaaagcttatgttgaaatttgatccccaatatggtgttgttgggaggtcaggcctagtgggagatgtttgggtcatggaggcagacccttcatgaatggcttggtgctattcttgtgttagtgagcgagtcctcaccctggcaagtctgaactacctcttggaggaattaattcatttctgggagagtgggttgttataaagccagtacatccttcaggttttgctccacctttgaccttctccaccatgttttgagctagcatttgtccctcaccagaagtcaaacagatgctggccccatgtttctcatacttctcagccttcagaacgatagtcaaaatcagcttctttttttttaataaattactcagtctcaggtattcttcaatagcaacataaaatggactaagacagaaaattggtaccagggagtggggtgttgctataaagatacatgaaaatatagaagtggcttggaattgggtaatgggcagaatttggaagagtttggaggagggggctaaaaaaaactgcattaccatgaagggtgcattaaggacaattattgtgagggcttaggaaaagagaaggctcaggagaaaataaaaagacaagagaaaatttgcaactttttagaaatcgttttagtggttctggccaaaatgctgttagaaatgtagacaagtaaaggccattgtgatgagttctcagaaggaaatgaggagtatttatctgcaaactggaggaaaggtcaacctggttctacagttgcaaagaacttgggtccatgatgtccatggcctaggactttatgggagactgaatttaagagtaatgaactagaatatctggtggaagaaatttctaagcataaaagctctcatgctgctatgtagctacttctaactgcataaggttaactgtcaggaaaaggggaagcagagtgtacatttttggaaaatttgcagcccagctatgtggtaaagaattcgtgttttcaagagaggaaaccagaggtacagccaagagaccctttgctaaagagattagtgtggatgaaaaggagccaggtgctaatagtccaaacaaagggaacaaaatcccaaaggcatttcaaagctcttccatgctatccttctctttgcagtcccacggcctgagaaagcagagttattttgaaagactatcctaagcctggtgccctgtgttgcatcaggaccctgctttgtacatctagcagtggctcaaaaagccccatatgtgtctctggctactccagagagcccaaatggtaagccatagcttccacatggtaatctgcaagtgccaaaattaaaagagccatagagatattacatgtgctacctagatttcacaggacagcttggaaatcctgaaagtccagtcagaaaactgccacaggggtggagccactgccaagagcctctactaaggcaattcccactggaaatgtgagcccagagctgccacagagagtccctactggggcaatggttaacagaaccatgggggcagcatgggagtggggccccagaatgttgcagccaccagcagcatgcaatctcagcctggagaagtggcaggcatagaactccaatttgtgagagcagatatgtgactatgcccagcaattccataagggcggaggtgcctgaggccttgggagcccatcccttacaccagtgtgcccaggatcatggagtccagtaagatttttctggaactttaagatttaatgtgtgccctgctgggtttcagacttacatggggtctgtcatttctttcttttggtcaaattctcctttttggaatgagaatgtttaccaaatgtctgtcccaccattgtaatgtggaggtaaataacttgctttgctttcacaggctcatagttggaaggagcttgccttcagtctcaaatgagactttgtactttaaacttttgagttggtgctgggacaagtcaagactctagggactactgggatggaatgattgtatttttgtatgtaagaaagccattggtttttggagtcagaggcagaatgctatggtttggatatggtttgtctctaccaacatacatgtcgaaatttgattcccgatgtggtggtgttgagaggtggtgcctagtggaagatatttgggtcatggggtcatatccctcatgaatggcttcatgccattcttgtgatagtgagtgggttctcactctggcaagactggattagttcttataaaaatagattagttcctaggagagtgggtggctataaagccagatgttcctctggtttttgcctctctcttcacacatatctgctttactctgtgacctttaccatgttttgaccaagcacatggcccttaccagaaactgagcagatactggcaccatttttcttgtatatcctgcagaaatgtgagctaaataaatctcttttatttaaattactcagcttcagatatgctgttacaatgacaaaaaacagataacatgtatgcataatgttaccaaaagacatatggtaacataaaatatggaagcaatcaaaagcccactgatggcgaaatggataaattgtgacatgttcataaaataagaatagatgttctaatactacttacaaacatattgttgaactaatgaagcaagctacaaaagagtaccttcatatgaagtacagatccagcaaaactatcctatactgttggagggacggtggctggaaggatgcatgagcatgttcttgaatttctgtttattgatgtcaatgctgattgtatacccaatgttcagtttaagaaaatcaatcaagtctaaattttttgtatattgaatacctttttgtgtgtacattatgctctgatacaaatttaaaatataactcataataatgtggtaaatacaatagtataatgggatagtggaggtaggtggagggttaccctagatatggtgttcaagaaggtttctgaggctgtatttgagaaaaaaaaagagacaggaatagaaagatccaggtgtagagccttccaggtaggaagaataacacgggccaatgttctgaaatggcaatgatgtgttcagaaggcttgacagtgatgcagatcccgaatgagtaatgggtggagaaggcaagtctgaaaacatgggtagtgaccagatcagaaaaggcctttcatgctgtggtacagaagttggaacttgacttaatttgcaaagaaaaaccattgagaggtttcaaacaaagaaaagacagattataaataacattctgagaatgctactctagctgctttataaagaatgaactaaaaacacctgttaggaggcttttcctgcgttctaaagagagacattttcagcacgggttagagttttaggagtagaggtgacaggaagtagtatcactgggatgcacttgaaggtgtgaataacaggcgatgattaataaagtatgaggtctgaaggaaatagaatccagaagagtgcccaggttttaagcttgagcaacaaaattgatagtggatctatttgttgaaatggagtgaagacatttctatacttttaatttattttttatgtttttgaggaatattgtgctttgattgtatcaagttaagcaagagatgataacagcatgatgagttttgcctttcagaaagcagtagcatttatcgagcccgagaagttgagtctgtagtgagccatgatcgtgccctgcactccagcctggatgacagagtgggaccttgtctcagaaaagaaaaaaaaaagcaaaaagcagtagcatttagaaagcagttattactatatttgactctcaatgacggaagatatcataagtcaacacctagaaaaggctagcgatagatacttttattgatttaaagtactttttaatggctagtgatggatacatcttatgaactttccttttgggttatgcatcttggcatttcaaaaataatctttgggtaatgttttcaaaactttaacattttcaaaaagctctgtttgaaataccatttgacccagcaatcccattactgggtatatacccaaaggattataaatcatgctgctataaagacacatgcacacatatgtttattggggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatttcaaggacaaaaagccaaacgccgcatgttctcactcataggtgggaattgaacaatgagaacacatggacacaggaaggggaacatcacacaccagggcctgttgtggggtcggggggagagggatagcatttggagatatacctaatgttaaatgaagagttactgggtgcagcacaccaacatggcacatgtatacatatgtaactaacctgcacattgtgcacatgtaccctaaaacttaaagtataataataaaaataaagaaaacacagaaaaaaaccccaaaaagctctgttttacctcaatccaatgattttatgcatcaatattctttcttatgagcacggtcatctgcaggggaatgtggggtgtgtgtataagattaagagctttattatgagtatgttaagtttgaaatgtctattgaatatctaaataaaaatgtcaagcagctagatattttagtctagatatcattttaggtggtagatgtgaagacaggtttcagaattattgatacgcagattatgtgttaacagaattaaagaataggacaagagaatttcaatatttaaatactagaccacaaaaaaagtgacaagaaagggataaaaaagatgtggagcacccagaggagtgtggtgtggtagaaacttagaaaagacagtctttttaatagaagggaggggtctacatgtgagtttttgggtaaagtttaagtaatgtgaaacagaaagttgattgcctgagagtgcaagataacagtcgttcctatccttcacagaggggcttcgatggagtgattggacagaatatcttgtgaagtagactaaggagaaaggaggctcaaaaattgaagaaaatcacaaaagtttgctctgaataatggaacaaatataaagttatacatggatagtgacatggggttaagggaatattttttatatatgtatatgtacatatacatatatgtgtatgtatttttatatttattatgtatattacatataatatatatgtatgttatatatatttttatatatgtatatatatgtgtgtgtgtgtgtgtgtatatatatatgctgttgacaaaagccaaactctctaaaatatttgaagaggtttattttgagccagatatgagtgatcatggcctgtaacacagcctcaagaaatcccaagaataatcttaccaaaattggtcaggtgacagcttggttttatacattttaagatgacagaaattacaggcaatatacattttaaggagaagacagaaattagaggcaaagacataaatcaatgcatgtaagatgtatgttggtttggcacggaaaggcgggacttcttgaagtgacaacttataggtcataggtggattcaaagattttattatcagcagttcgttgaaagagtcaatccttgtctaaagacttaagaaatcagtagaaagaaatgcttcagttagggtaagatggttttcaaaaccacagttcttgttatatagacgaagcctctaagtagcaggctgcagagggaatagattgtaaaatgtgtaagactcttagttaagtatcttctgggtccataaaagacccagaaacggaaggagattctctagagaatgcaaatttcccccacaggaaatggctttgcaggaccattctaaaatgtgtcaaaaatatattttggggtaaaagatcttgattttcttcaggacctgctatctgtcatatgatactatgccagagtgaggttagaatttggtatcttgttgctgcagagagtctgttttgtcagcctcaggacctctattttaacattactgttgctcagttgtgcctaaactccaaagagagggggtagaaagagtcatgtctgaactctcttctagttgtttggtttctttgcgatctccttaaccaggagagtgtcagttggggtgggggcttagacttttatttttggtttacattattctccctcaggtcaagattttccagaggcaacattgatggccaaagttttatttgtcctctattgttgccagagtgtgtggctatggctatctgccccaggtgcatcatgttctttggtgggatccgtatggccaaggggcttagagccaaaagacttatagcaaatttaaatgttgtagggctggatgagaatggagatgggcaggcatttatcagccgttaagatctttaagcaatataagagcccaaaaccaaaagataaggttacaaaattgacttatcaatacattctgtgcattgagcaatacaataatcttgatttttgttacagacttctagcaattagctgtaaataacaaaagcattttgttgaaaccatttaagctaaagaacacagaggcttgttttgtgctgcagtgctttttcgtggtctttttcatcatttgtcctgaggtggctgatttaaaaagttacatatatctgcataaatctcacagctaggagcagtatatccaggaggctttgtgacgaggtttcttgttatgctcttggtaattttcttttaatcctgggacaagcataaaattctttatagttgggatggatggaaagcagccatgtaatagcccaggaggaaaaggcccctaccttgccagctgtttaggcatctggatgtctgtccttgatttggaggctctgaaataattctgtctctgaaattaatcccttacaagctcacctgcccacctcttccacagtagcccctgggtctagagggaaggtgcctatgtagccttagtagcaaggtgttagcaatgaagacagatcaggcccagtgagagtctaagcaggttttacatttggcagatattaggtagagagacaaaggtaatctatctgtgttttaccaattttgtaagctacatatagctcaaaaggaaaaggcatttctttttttactctggaaaacaaaatgtaaggaatcagcaacattttaaagaaaaagagcttaattcctgccttgctctgacagaagacggaaactcacaggtagctagcatttattatctaacattaaggcatagaacaaattatattaatttagatagagaaaaaattattaaatgagtattcatgcctttgtatacaagcctggtttagtgtcatacaaaagcagtttttttcactctcatcttctcccagctctgaagatgaggctttggttaacttacatttgatgtcagatactgatagcgacaggaagcagaaaaattctgggccgaagagggtgggtgagggccccaccctcaaacctggaactgtggcccagagtgagaacatacattcctgtttcccactctaatgttgccttttctaaaactaccaatggcctgtccccaccatcatcctgtgcccataaaatcccaggctcagctggcaaagaagagaagcagcaggacatcagtgactatgcctggatgttggagcaaattggcttcatttcagagagacagcttgatggtatagcttcagagctttaggggaagcttaccttcccaatccattcccttttctgctccccttcccactgagacccactttcatcagcaatgaaatccccgcatttaccatctccaatttgttcctgcaacctcattcctcttggatgtcagacaagaacttgggtgcaggtgcaaaaggctgtcacatttaccctccactaagctgttaacacttaagccatctgtggatgtcaaagctaaaagggcactgactgtaacactccttctggggctttgggggtcacaggcactcccctagacgctgccatggggccagaatgaagttcgttcctgccggcacccaaaagtgctagccccagctcctgcacctgctcagctgcatgcttcctcccgtgatgggttgatcacagcaggtttgagtgaacagagtttgcacctgctggcaccgtgcactccagttcctgcccacaaaggactcagggaaaatttctcgcttcaatgtcagcattgacatttaagattcagtaggagtcagtgctcctttttaaatgagatatgtgtacccagaagtcaaatacctgaaacttaagagcaaaaaggttagtaacaatatttgataaagacccttttcaatgaggctggagggagttttttaggtgagatctaatcatcaggctggaggtggtgatagtggagtttatgacttaattgaaaactgtaaaaagatggtatagcactgggtaattaatttgtatagttttgatgaacccccggcaataagtctaagtcagagacttaacttagaatttgatttttgaggatgtttgtcaaaagatattgaaaggctcaaaacatttgattaaaatgaatcaaaagtcattgtaaaataatagttattcatttaaccagaatggtaatcaaaagacttcaaaagcaatatagaaagttacatgaatataaaaccctacctggttttaaacctatacttttaggttttaaaatggttaagggttttataacaacacagtaattatcttaaaatctgtatttcctaggctagctgtcaaaaagtaaagaaaaaccttatgcagagtgattgttttgagtcattggaagcccatttggataacctgaaagtcaagcctcatgaaaagataatgtgaattaatcagacacaggaagagtgtgttccatgtcatgagtgaacactgttatagagaccttgagcaggggaatatgtgactcttagcaacagcatgggatgttgcctgggtatactgagcacttttaaacctatgttagagctcagaaaacaatatcccaaaatgaaggatttagaggcagctgcagaagtaaaagtttttctttggccttcttctggcttcctgtttgcaagtcccatgctccctcaaggcgggtcatagcaactagaatctcgctttcccaagatgagtcctcaaaactgaaactcctttttctcaaagccagccataaaacctaaaaatattactccaatattttctctgcctttctgtgaaagaacataaggatattatctgatcttccttttgaactgtagagtgcaagacccccacacagagaaggaagaaaatgaatgttcaaggaggttaagaagaatctacacaggcaggtcttgctggggtttccccacacagtccactaacattgaattatacccttttccatcatatttttagatggatgtccctaattttttgaacctaagcataaaaatgcacaatttcccccatttattggatctttgttctgagcacacccatgtatacatgcccaaaaaactgcatatctgcttctcaatgaatctgtcttttttgagttgatttttcagtgaaccttcaaagggaccctggcccctacacattttaagaaaagtcaagagtaacaaattaagttacaacagaggaagacatcacttttttaaatcttcaaaagaaaacattttagtatcaggctataacacagttagaattgaagaaaaaaatagttataggagacaacaaaagttaaaagagggagttaccattccaggccttctcaaagggagaaaagctgaaaacagtggggtatatcaggagttaagcttctgaaatatcaatctgagagatttctttcttttttttttttttttttttgagatggagtctcggtctgtcacccaggctgcagtgcagtggcgcaatctcagctcactccaacctccacctcctgggttcacgccattctcctgccccagcctcccaagtagctgggactacaagtacccgccaccacacccagctaattttttgtatttttagtagagacagggtttcgccgtgctagccaggatggtctcaatctcctgacctcatgatccacccacctcggccttccaaaacactgggattacaggcgtgagccaccatgcctggcctcagagaaatttcaaaaagagattatagaattaaaaatgtaaagctttttgtaatttcatcaaaagtaaatcaatactttaagaaaatatatttgttctaaccaattcgtcagttttatattcatgtattttatgaacttttattttaggttcaggggggtacttgggtaggtgtcatataggtaaattgcatgtaacaagggattggtgtacagattatttcatcacccaagtaataagcatagtacccaataggtggtttttctatttgtgtatttttaatattaaatcccaatctctaaaaacactaatacgaataattctttttaaattatcaccagcttaatcacatacaaaattgttttgcagtgagcaggtctatacaaacctatccaaagttggaggaagctgagatgctgaagaaagaggctgataaatacagtttcttaggcagaaacaattaatagggacttatgaacagaagccatgtctgtgtctcaggcagcagtgagataagatggtaaattcctgtgccattaaccccagaacccagggcttatatgccatagagaaggaatgattcagaaggcatatgtgggacaactgaagtatgataatgtaaaagttgtttgtcctaagggcaggatttataataagtacctgttcttacacaaggagcaataaataaactggaaatcttaaaggtcttcccacctggagttaatcagaagccaacagggcagatcaccattcaagatggagttacttgagcctcccatctaagaaagagtagctttagcctccaaaacatttctttcataaattctctttataaactttatcatatcttacacagactatttatgacatacttggactttctgttttgtccaaaatttccctctttcttaaataacgagttttttttttttttaggactaaatttactatacaagactctttctcatacaaaattattctttttacccaatttttaaaataaatacatctttggatttgtataatagcctttgaatttgacaaagattattttccttttaataagaacatatttttatgtctttattataatttctttttcataaaaaaacttactttggcactctttgaatacagaattatatattaacaagaatttttattcttagtaaccttaattttttgtgaaaacctaggaagtagtaaatcttgaattgtctgtcatatatcagtattttatagatgagaaccgttttatattattttagaaatatgtttttctgttttttaaattagaagtgatccagacactaaatgagtattatttaatttaactttaagattttaaattatatgacaagttcatttataagcacttatcccattaaagttaactaacttattttttaaaatagttttcctaggttacttataaaaactgacatattagacaaagctagtcatcattagttattttcagctaaccattcttataggctgtgtttatttcaggtgtttacctacataagaacctaaatgttaaatatatgtttatttgatttttttttttgccagctaaggttttacctattttcaataaatcaacaatattaaatgtcttatttataaaaaattatgcaaagatcattaagggatgggttttatagttttataaccttcatgacaaagtttggtactttataatatcaacacagctaaatacaaaactattttaccaataaatccagacaaaaatgtacgctgacaattctgaaggcatttcaaattttattttactaataattataaaaccagattacttattgaagatttacttgtcatgtgaacttgaagagcatttggactttattagtttatgagtaatcctttatttttaagcccatttgataccttgcagttacaacatataagaaaatacatgtacatgtaacataaacacaactcaacatagatacacggatacaaagatcccatagattttatttcagaattctagtcacaagacagcaatacagattcaccagcttgcaaaagatggtttaatttaaacaatgggttttatctcaataccagtagaaaagcaacaatacatttaaaacagaaaaagaaaagagagaaatcaagaactaagcagatgccatatttaattctatagttgcaggtcaactttgagctctgaatttacccatcagtttacaaatgtgccagaacagactataatacataaccagccagagtactagaaaaccaagcatgctctcaaaacttcacatttacacaaacaattgcgagtgccataaaacccccaggggtgccccaaaggaggtcatctccttgtcttttctcaatcttagaggatttgcttcccaggttttcttttttttaatggaggagccagactgtagtgtgggtttcagtgcagtggggctcagaagctgtctctcattcatttacacaaagtcaggtttttcaagcaaatgcacagatgaaccaattgagactaatttttggagaaaaaagcaatgagaagactctagaatgaacctgtgaatccaaaattagaatctgaaacaacaagttcccaggaaaagaccagctcagaataaaccaaagtactattaaccacgtaagggttctgtggctcaggaagacttacttaccagttccacctatggagaagctcaaagtcaggaggctttcaatgagcctgcagcaggagaatatgatctggagacctggagacagggaacttaaggccaatttatgctaacttcctaaaagagaaaacaccaaggtctggaagcaggacctggacaacttgtagtcaagaccctccactggtaacaagcccatattggtaccttatttccaagttcacacaacttcttttggggaggagagtccttagtcttctctgaggtcctgcattgggcaccaaataatgttgatgaagaaaagtgaaactctaaaatatttgaagaggtttattctgagccatgagtgaccatggcccaggacacaaccccagatgttcctgagaatatgtgcccattgtggttgggttatagcttggtttgatacattttagggagacaaagttataatcaaagagataaatcaatacatgaagggtatatattggttccagaaaatttagacatgttaaagtcaaggctcccaggtcagaaatagattcaccaattttctgattggcaattggttgagttaagctttgtctaaagacttaaaacgtcagtagaaaggaatgcataagattacatagttgtggaagccaaggtttttgttatagaaagaaacgcttgagttaagataatggggttgcggaagccaacgttcttgtcatgtagaggaagcttccatgtatcaggctttagaaacaatagttggcaaatgtctctctttcaccttaaaaggtgtcaggttcttagttactctctcctggatctggaaaaggcttagcggcattaataaagtttctctacagatgcaaaatttcccccacaaaagatagctttgcagggccatttcaaaatttgtcgaataaatatatttcagggtaaagtatttttatttacttcatggtttgctatctgtcatgtggtgctatatgagagtcaggttgaaatttagtatcttattaccacctataatctgttttgtcagtctcatgatctctgttttaatgttaatgctggtcagtcatttagcactcaatggaaatgctagagaccacaagtatttagcttaactctttcaacaaattgccagtcaaaaaactttttaatccacctatgaaagcttctcagtagcaggcttcagagaggatagatggtaaaaggtgtcagactcttagttaaatgttttctggatccttatgagacatagaaagggaagcagattctatacagaattcagatttcccccagaagagttggctttgcagggccattccaaaacatgtcaaagaaatacattctgcggtaaaatacttttatttccttcagggcctgttatctgtcatgtgattctatatcagagtcaggttggaatttgctattgttgccacagtctgttttgtccgtcttataatcactgtgttaatgttaatgctggtcagttgtacctaaactccaaacaaacggagtacaaggagtcatgtctgacctcccttcctgtcatggcctgaactagtttttcagatttctttgagatctccctgggcaagagagttcccattcagtcaactacagggcttgggatttattttattattattattattactattttctgaggttgcaacacagagcccaagtaggaggtctaattttggatagaggcagaaacactgtctcatggaatgcaagagtaaatacaataaaatcagagagatggaaaatagagtacactcaagtatgttgcttattttcagtcttctgatgcctaatccctcattgttttgtagtcacatggttatttcttggttcttttataacatttttcacaactggattgctatgattgtgcagacactgtctactagagtcaaattttgttttgaaatagttcattattttatttaactgcgtaaactagtttagtctatgatgaattaatagacagatgtgaaaaattttaaactcctctgtcagggctcagaacaagatccttccaaatatggcttcttgatgaaatctaaaagtaaaaccctaagccccccaatcaactgaatggattccccttcttggccagtggagctgagagcaatctgaaaaagtaaatttcaggccatgagggaagggggattgggcacaccttgttgcactccctccattgtggaattaacattaaaatagagatcacaggactgacaaaacaataagataccaaattccaacctgactcccatatagcatcacatgacagatagtagacactgaaagaaataaaaatattttaccacaaaatatatttatatgacagatttcgaaatggccctgcaaagctatcttttgtgggggaaattttgcatctgccattagtgcagctaggccttttccagatccaggaaagatagactgtgaggctcacaccttttaaggtccaaaaagagacatttaccatctattctttctgaagccagctacatggaggcttcatatatgtaacaagaatcttagcttccacaaactcccttaccttaactcaaacatttttttctactgacttcaagtctttagtttaactctttcaaccaattgccaatcagaaaaatctttgcatccacctatgactcataagccttccacttcatgtcctgctttttcaggctgaaacaatgtatattttacatgtattgatttatgactttgcctgcaagttctttccctaagttttagggagacagaagttaccctgggcacactttctcaggatcttctgaggcttttccccggccatcgtcactcatattggctcagaataaacctctttaaatattttacagtgttcagctttttcatcaaatgcaaacttgacatactaaataagctgaagaaaactgagaaaaccgaagaggtagaaaagtcactttctgattttttctgcccttctcccctgagagctgtccacaaaagaattctcagacctacctgttctgagagaaggtaataagccctttattccagaggggccctgaccaatgcccagagggaaaaaaatgtcacatggggaggccactaagaatctgaacaaacctcgctaagtcctcctcctaagtttatttccattatatcatatttttaaatgttctaatcatacttttaaggctcgcatgcctcatgaaacttctactaagtaaatttgctatacttttctgttgctaatctgtcttttgttagaagttaccaaccacgaaccttttgatgagcaaggaaaaaatgtcttacttcccccccacccccgccccctgtaccactaattataaactttgcaaagttttgatactatcatcttatggtgtgacccatctcattcacagggaagtcacaacacagctcatgtggtccatgcagtccatttatacgggattttgctaaagtttctatactcctagattcttaggcttagcatcactaagagggatagaatgtgtgtctgaactgtatccgttcattatatcagggacagaatgtgtgtctgaactgtatgcattcattatatcagggatagaatgtgtgtctgaactgtatgcattcattataacagggatagaatgtgtctctgaactgtatcagttcattatatcagggatagaatgtgtgtcggaactgtatccgttcattatatcacggatatgaggtgtgtctgaactgtatgcattcattatatcagggatagaatgtgtctctgaactgtatcagttcattatatcagggattcaatgtgtgtctgtgaactgtatccgtttattatatcagggatatgagttgtgtctgaactgtatcagttcattatatcagggatacaatgtgtgtctgtgaactgtatcagttcattatatcagggatatgaggtgtgtctgaactgtatcagttcattatatcagggatacaatgtgtgtctgaactgtatcaatacacataacctacttctgaaacacagtaaggacagggcttggcccccactcctactatcacattttttttcccgtacctgccaacttccagaccttgcaccaccacctccactggcacgatacccactgcatggataacttgaagaaactaagataagcagcattccaccataaatcttattcaagggagttaaccttatcactcacatgtgcataagaccagaagaatgactgatctttaccccttgcttcattataatactaaaatctccacccagggaagggcttacccaccattttttgatcatgcaatgtatgtgttcacataatttctcactgtgcctgcatatcctgtgctccactccacatgtataaagagcctcccatacctcatgattatccatgtcactcatcttaaaacacagcaaaggcctagccatggggaaccagccagagaactgtcattccagtgctgtctcccttgtgttcgagcacaagcccttaataaagccttgtctggaaaacttgcttggtctcatgtccatttctattgcacaggagcccaagaacctgtggttagtaatactttcacattttggcctgaatgaatcaggtactgtctgtttagctgataggtgactagtttcctttattattttcatagttttacatcttatgtatcaatatggtttggctctgtgtccccacctaaatctcatgttgaattgtaattcccagtgttcagggaggtagctggtaggaggtgattggatcctggggtggatttcccccttgctgtactcatgattctgagtgagttctcctgagatctagttgcttgaaagtgtgaagcacttcccctttcactctctctctcctgctcagccttgtaaagattgtacctgcttcccctccaccttcccccatgattgtgtgtttcccggggcctccccagccatgctttctgtaaagcctaagcaactgtgagtcaattaaacctcttttctccataaattacccagtcccaggtatgtctttatggcagcatgaggacggactaatacggtatctatctgtaaacaacagagtttactcttgcctaattttgaactttaaaaatgaagttactttgaatatattattttgacttttttgctaaatataatttttgtgatattcagctcattatcttgtatagtttgctcattttccttagcatatgcaatgtcattgaatatcttaattgatatatttattctatagttatttggtatgtatgttattttcagcttggggctattatgaatgtttttgctattgacatttatgtccttatgttttcatatataaatgcaaaaaacatagtgcatatacctatgggtagaattgatgggtatatatttttctgacttataatgaggttgagtaacttttctttgatttatcagccatttagagtttctcttttgtaaagtacctattcaagtatttttcccatttgctatcaaattttggccttttgttatagacacataagaatttttttatacatgtgctggatattttgttttcagttttgttacacatctgctagtttgtgacctatccaagtgtttaaattttatttatttgtaaattgaattaccaacattttactttatattagttctttttgtgtcttaactaatctgttcacaagctgaagtcaagaaaatattatcctatcttatcttctaaaagctcatagtttttttttttgtttgtttcttcaccttttagtttttaacccgcctaaaacatatctgtggtatgtgactttaggcaaattttccattccccatatgaacaaacaattttcccaatacaacttgataaatttatttttcccagatctgcagtgacatctctgtctcctttatagtcacattccacaaaagctttgcctgctcttggtctccctaattcctccactgtcctctctattcaggatatttacctctcatttcaatgatctttatgtggataaatcaaatctttcagggccatcagcacagtttttgtttgtctgtttttttccttgttttgatataactgtctattccctcgattgaagatgtgtgttttgttttgttttgttgcattttcatctgtcttcaagtacaccatactgatggcttttcctaactcattgttttgtttttccttttaattttttttctccttgtgtcatttctccaggcccacttcttaatactggagggctcctagctcagttatgggtcctcttcttttttttcctgtaccttttctctgttaagctcattggggttcttagctataaacatgtatctatataataatatctatgtattaatgactgcagttcaaagcaaacttggcattcaccaaactgatctgtgcctctgtcttcccaccctaaacttcctgcaactgcgtctttccttaggcccactggtaggaggtccataatttcagttgctcaatccaagcccttagagttgcccctggtgcttctctttcccttgaaactgacatccaactagtaaaggaatcctgttggctctaccttcagaagacacctaggttccaaccatttctacaatatgttcctgctttacctaaatcctctaagggttatttctaaagcagcagttgaagaaacgtcagatcatgccactttggtgattaaaaccccactgcagctcaccgtttattgggagtaaaatctaaaattcttacaggaagctctacagggcccttttacatgctcctctgccccattgcctcttagatgtctgcttgtgccactgtttccctcactgctctagccatcctggccttcttgtcattctttgaataagccatgtacactctcacctcaggcctgtcctaccagttttgttttgtttttttttctccacttgggatccctcccaccccaacactctcttcagggctaaattctttatgtcctcaagactgcatgaatgttatccttccaaagagatctgtactatcgatgacattgtaaaaagcaacaaacattaccacagcttcagcaattctttctctctcttaatctactttttccctttctctataccatttgacattgacagactatatagttaacttctttcttctgtttgttattgttcactgcctctgggctacatgggcagcttcatgaggacaggcacctattttgcaaacaaatatatcccaagggtcttaatagttcaacagatggctgtacatagtataaattcgacaaacatttgtcagatgaaataaggtttcataaaatttctgtagatacatggacctatttctgaactctttattctttttttttttttttttggtttatttgtcttgtgatgtgtgagttgtatactgtttaacagtttaactttgaaagtaaatctgaatttctggtatgacaatttatctgcattgttcttatttaacattatcttggctgctattcttggctctttgatcatcattttaagaatcagcttgccagattgtattcatatcctccggctatctatctagctatctgtctatcttgggagagagagaacattgaatctatatctctaactgtagttctggctctaagtatctatcttcattaatctctgaatctatttctatttcttcagtatctcaaacaatcagttcctttttaaactccctttattattatgttaaagtatttcaaggtaaatagccagtgttttgtcattctagccccaaccatattcctatgcatccatgaaaagggagaacagtgcaccagtctgctcacactgagtccttcataggacttacctacaacaccccaaaatctcagtgacttacacaacaaatgtgtatgtctcaacttatagaagataccattcaaaagaatttcaaaattatttttgaaattcaaaagaattaaaatcacgaactcagaaaattgtacaacagagttcatagctccattatttacgatagccaaaaggttgtgtccatcaatagacaaataaatgagcaaaatgtgatatatacaaacaatgtgatactattctgccttcaaaaggaatgaaactctgatattttctgccacatggatgaaccctgaaaatgaagtgaagtaagtataaaggcaaatattgtatgattctactcatttgaggtaccctgttggaggccgaaagagtgagggtcgtgatcaactgagtaccccactggaggctgggtgagtaagcagcaaaactgcttctcataaatgcagaatgttggcaaactgacaaactgcgtttgccacacagaggttatgctgagggcggtcacgccccaggcacaagtgtttcttgttattaggtacgtctgaaagtctgatagcaatgatgtgaacctgtaatcaatcaagtagctgaccaattgtgacatcctcctccctgctctttctacccaataaatacggagggctgagaagctcgggcggctgcctttactgactagcagctgggatctctcttcttcccctaagcgagcctttccttaaaaccattttcttctgtcttttgttactatttctacgttcatttcttcattcagtcctgtaatgatggtctcaagtagtaattgtacaagtctgtcacaagtggtgcctgaacaggggcatctagggacaagtatagacctgaagaggcctggagggataaatagattagcagggatagagagaaagagtataggtagggaaagacaggaacttgcaggaactaacagggaccatggggacagatagggatagataaagactagcagagaccagcagaaacttgcagggacagacagggtcctatagagacttgaacgaggaaggtctgctggaacagaaactaaaactagccagacaaacgagaagccccattacaagtctgccagcagcaacataaggctagtgctctaaaaaggtacttgtcagtgccccagaggtttgaagaacgggaagtttttgaatcagggtagcatggggaagaatttggttatttttttctttcatttggagtttggtacataccttttctgttatttcagggccggagagactattttgccccacttagagcacctatcaaaagtggtaaacgagggagaatgaaaactggctggcagcatcttttgtggctacagaaatgctcactttgactatggcttatgaggctacaaatgtggattgggaacgtgcagtggcacctgtgaggtgtgcagaaagttcaggaggttttcttagtttttcaagatgtgggaactgagcttcactactttataatgttgattcaggcaacggataattttggtagttgacggatctaaaaggagccaagggttgagccctagagtggaaaagctgtaagtgtagagaatcggacgttgcaaaagagaatgccgtcagacctctgggcagaaggggtctttaaaacagttctcttctcaacagaaaaagtgccaggactttgccctcgttgaaataagggaaatcactaggctaatcaatgctactctatatttgaccagaacggcactccctgtggggaaaccagaagcgggcctggacctgggcacctcgaacaagggggcttccccagtccaggccgcaactccgtttcaggggggtttctggaggtgctttgactccccctcctcaagcaccaggaagcccaggattagatctcccaaatgaacgggtttaggggaaagcaaccggccttggagggggaaagcaaccggccttggcggggaaagcaaccggccttgggggggaaagcaacctgactcacactggcgtttgggacctttgccaacaggataggtgggattaattttaggcagaagtcatcttaacttgcggggcattactgaagtcccaggagttcttcggcttatggagaaattcaggtagcggtcatgtcccaagatctctgggttttgaagcaggagaatatattgcgcagctgttgctcatcccctgtaaattgtacccttctctacgtaagaagcgaggaggtcaggcatctgcaagtacagctgggagaaagctatcacaacccacagcatctaacagacccgcctgtgtaagtgcaaatggaaggtttaaggattgcttttttgctacactgttgcacgagaaggataagcctcaacttgttttctctgtgccttctgttcatcagaaaaagctgctttcactatcaacggaaagttttaccccgcagcaattaggccaagaggcagaagctgcgccgcagcttgtggagcggaggcctcggcaatggcctggctcccggctgcagccccagaaagctttttgcttttgtagagttactaacgtggggacaggacatgcctgtgtctttacaggagatgaaccgtgtgggtgccctcgggaccgagggccgaccgcagtcccgctgacctcaacccccataatacagggacagacataatttaaaaaagggttggaggccgaaagggcgagggtcgcgatcggctcggtttaccactggaggccggacgagtaagcagcaaaactgcttctcacaaatgcagaatgttggcaaactgagagactgcgtttccgcgcggaggtggagcggagggcgtcacgcgcaggcacgagtgtgtcattaggtgcgtgggaaagtccgatcgcaaccatgtgcacctgcgatcagtcacgcagctgatcaatcgtgcgtcctcctccctgctcctactcgatccatgcggagtgctgagaagctggggcggctgcccttgctcactagaagctgggagctcttcttccccgagcttagccttcgaacagtgtttttcccccacttctacctcccttcgctcagtcctgtaatgagcatctcaagcagtaacagtaactgcggtagtgaccgtctcaagtagcaattgtacaggtttgctacagtacctagaagaggaaaatccacagaaacagaatacaccttaccccagagatgaggaaaaggagaaaatacagttaatgtttaatgggtacagaagatttgtttgggatgaggaaaaagtcctggagatggatggtggtgatggttgtatcaacctaaaggaaaaaactgaggcaaagttaacacgcatatttggaccaagattgggaaatgcaatctgaggagacagattctagtagccttaaataaatgctccaactaacagcagttataatggggcctctaagggaaaagggaagttctaagctgacataaactattgatcaactagacattgttcttttgtagctattgataagctatacactattctctgtagggaacatgaagatggttggtaaaggtcatattgtacaacttgtaacattttaggtaacttatcagctagtctggaaacttcgggggagcggggggaagtataaaattcctttaaacaaccccaggtgcgcatgtgtgagcagggctgggtagggaagttattgaattctcatgctcgcgtctctgagcctaagacgttttgtaaagctcacattcttcagactgctctgaatcatttttctcagtttcaaatattttctaaggtcagcttttggggaagctaaggcaggtcatatatgaaagtaatttaacagtggctttctcagattggacctcaatcctaaacaaaggggaaagacccaaagaattttctaaactaccaaaaaacttaaaaaatttcaaccaaccatactaggattgaatcatctcttcttgcttatagaaaatattagagtacatagtaatgtagccagttgttggaaaaaatggtaaaagtggtaagttcaaccagttaagatttaagttgaggtgtttatgtatttcttcgtggtattttgtcagctttctaaaggtgtaattttgttggagtttcactgaagagaatattatacctgtgcaatcatgatttgtagcctgttttcttaagatgccccagattgcataagcttcagcctcagaaaacctgaattccaacccccactaacttaaacaccagtgaggtaaatatgaattacatgaaagccaagatcatgcaggcatagattgcagcacaacaagactgcagggtctaaaattcccccccacccttcccgctccccccaggaatcgttgtgggcccttttgagaatactggatgagaaaaggtctgtcttcttgaagtaactcaaagatcttatatacactgagattagtaaaatgaatatttttaaatgcttgcaatgctgaaagttttatgtattacaagttacaagaaagacaggatgattacatactaatacttgagtgatggggaatggcccaaaatgtatcttttgcaagacaatacttccttagaaacattgatttctatttcaagagagatgcctgaaagttggaagtgtaaaaagagaaactttcaaaacaatgtcgtgaacaaagtaaaagagaaaaaagcaatttaagttgcagctgccagcaacctgacttatcttgggtgtttactttgtaaattgagaggttacatttttcttaaggagtctgtcacattttatatgaactgtaattgcaggctagggacaaggaccccagagacagtgatgtcaatgtatctcctgaatgggagtactagccatcaccatgatgcaagctctatttgtcactggatctctatcttaacagcctgcataatgcagctgctgtcaactgacattaggcatttacagattcaggctgttctatttctcgatcttcaaaggattcacctatcactgtattttaaaaagtctcaataagttagggactgacccttatccttctgccaacaagatgtaattcccacgcctaatccactgtaccttcttgtttgaattcatactctccctgcctgtactcccctgtttcagttcagaaaacaagtttgaaatacagaacatagaatacctccagtttagaaagtctgatgtatgcctcttagttccccatacttactacataaaaggaaatgctgaacaattgcatgtactaccttagttctgtaaggtttctctctaaatattcagatcatcgtgtttggggaagatactgtgtaaggtaagtttgcagtcttgatgctgatcaatcgcaggatgctttaaatagattctggacttactagaaagttttggttcaaaccagagaaatactggagaatgttgaagtttgatacatctgattttgaactgcagatacttgtggatagtactaatatacaaatcttagataattcaatctcgtttcttagtagttatggactcttatcttttctgtacatcagaatgtagcagattacttgaattctatgcagatctgtctgcataatgattccaacagtttttatcattgcaacatatattcacctataattttaaaatctttataaagagcttatctaaatcgtagtattccaccttgttaggtacctcataagcatctctaaaaatggtttagttaggaagaccctccatatcctgctccgagaaaccattgcagcatacttaatacttagaagttcccagaagctgaaaagaatgtgagtggcttgccagacgtccagaagcttatcagtgatgaagatagaatataaagccagctttgattaaaaaccatgtcatgtagcattgtgaacattaaacatgccaagaatgtttcaagggttaggaatagacaggggaagaactcagttcaacttctgtagagactgaaggtgatcatgcccttggtctgcttcaagacaatccctcggccttaatcaaaacttctctatcgttctaaagattccccaagtgattttactttagttgtggaagaaaagccattttctagaagtgacacttcatgtgaaaatactgctggggaggaaacataatgaatctgattgtacagagaattaaatgtcttatagtcagggtcaccatttagccctgttttctcaagatattccctttcttatgcctgttgtcctcatgtcctgtctagcttagccttttagcactcaaacgtattctgagttagatggtcaccaagaattgtgccaatctttgatgcagagcagggtctgacagaacgacaacaaaaatgaaaaagtagaaaacttggctacctgctgctggacctgctattgaagagaaaaacataatggacagcaaagggtgagattcccaaagctaactgtcgctatcacagtcttaaggttaacctggcactcatttttagtactcgctttttataccagaatttgtacatgcaacaagggtgaaaactaattttacccatgacagtgttcccacatttccaacagttctccttgttacttaggtcattcctgctcatcattcacacttgaactcctgcttatttgaagaactccaattagatagaattcactggcatgatcttaaagtacaaatttatcatggttgatctcataaaccaatggttgcatagttttaatgtctagaccaaagattttaagtgcatagaaaattacattaaaaattttaaattgtatattaatcacatacctcgatggaaaatattttttttcaaaaatccagcacacagaatgaaaatgtctgaaatatttcaaaactttttggcctaaacatcaaagttacaattacatgtatgtaactcggggggcaaaatagctgcactaaattgaacaaaagaatagtctatagatttttattttttattaataatcttgacaaatcacctatatagaaaaggtcatgaaaaatcaaaatagccaaaatatacactatgttcaatttttttcataatcaaatccatattgtgagtttcgatactagtgctaaatgctggggcaagcatgatgctgccgcaagtgtgttctcttactgttaagcatttaacaacttggtgataagcttctaaagcatagtaaaccattgtccatgaattatgccagagaattcacctcataatactgcatataagcaaactcaacaacgtgaatgtgaaccaagctgagtgtctcatattcaatcacagcaatagtctctataaagactgggaaagatgtgctaaatattaagtatacatagaactggacgtttactaaggtttggaattatgcatagacaattattacatggggcatggtataatccagttgattcctttattttccaagtattcttaaatgttgctatactgggtaactcttaaaatacagtgaatgaatcaacactaccagagttggaagatggttgtaaaatctgagtggttatggagccactcatatctcccctttccctttgtgaagtaagctggggagatccccagagtctcattagcaagtttcagggccaggagtattcatggtcagggttcaggacacagctgccctgataaggatatttttggaccaattttttcgtcttgggctttaatattcccagtggaccaatagcagtcactgtggctggtccccagtaggtagccaccattctctgaatttactgtgaaataacaagcacggccctccaaggatcttgttcttattaaattatggacaaccaggtctgggtgagcattcagcactctccatcatacgaattgctactaaatgtttgcctttaattttcccactggcttaacagtttttaaaataataaagatacattataaatcagctgatggaaagccctggcataaagctggtaatatttcaagaatgagaactgaaaaatgcataaggatataatgtgggtttcatcagtaaaaatctgaattttcatcgttttccatccatccactgtggcatggttgtggtggaatgtactgaggggccctggtgtgaagttcctgtctaccagccagtgggctgcagcttccatcatttttattgtcctttgttcacataccaagtaagtcaaaactgctgaggtcttaaaaccattctgaaagtgcacctgtggtcacacaacacacgttcatgtgcctcaattctaggctcgaagacagatgatgtcttacattctttcagggtctttcagaatatcaaactttggcttacccaatgtgcctctcgggaaatatttacggaatgaattgatgtctactttgtcctgttggaaaacagcatagaacaaattatactgtcactgtttaaagaacaatgttcctccttggggaagtttccttaagcctcattttcaactgtagaatggtctagtatcttacacagttgtttggaaatgtaaaatttacgaatcagttattaatgttcttactgctatttgcaggtgaatgcatatacaagtaaagccatttttctaatttggtacacacctaaattttttggctcaattctaatttgtggtgtttaattctggaggacttgtttggatgaaggtaattggagctgtcatattcccaggaataactctaaccagtgctgcctagtagaaatcctaggggagccacagagaattctaaattttctagtaaccacattaaaaatgtaaagaataggtgaaactaattttaatctatattatccaaatatatctaaaagttaccataatataaagttttaagaagacgtgttgcatatatttttaacaggtgtttgaattgttaactttgtgctgatggcacatcttgatttggagcagtcgtgtttcaggggctccacagcttcataagcctcatggctaccaccctggatagtgcagatctatatgatgcagggagaagctatccaaataactcataagtggtcctaaattgtggtaaaatatttaactgatatggatacatatgcagaatctaacttcaagtttgagagatcccttcttttgggatacactagctctaatacttaaactagtttattttttcataagttaaatgggattctaacattttaacgagttgtatgttaataatcggtagtttgctgctgcaagaaggaaagcaaacaccacttgaccctcaacgttttctcccatgatttttcctcctatgaattcttggatgacttctcagaactcagctctttttattcaacacaggctcattctgcaatactccacctgatacatgtaagttgagcactcaaattttacaatgtacaagtgtgtcaagaatggtgtaaattaggtcaaataatgcagttattcttccataggcaaatatatactcgtggtgatcttcaaactggattctaagtgtgagaactagagtctagtataaggagagcagtgtaggatgtggacaatcctcctttcctccccaccaccctatcctattgaatcaggctggttccattcttatgtcttatatgcatcctcaccaatgtaaggtggtactcgaaagacagaaataaatggtcatgaacaaaaagattgtttgatcatgaactctaaatagtaatcaccaaatcaagaaaatccttaaatgaacaatgatggtataatgagatgtagcacaatcctgctcaggcagttctctcagggaaattatgagcttcaagaaataagattttgaccttggtttcatgactacatcataatgttttatgtaaatcagatacctttccaactttatcatatctctttcgtgtaccctacagagctatggagcagagcaattattccgtgtatgccgactttatccttctgggtttgttcagcaacgcccgtttcccctggcttctttgccctcattctcctggtctttgtgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctgtgatcgctacgtagccatctgcaaccctctgcactatcctgacctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtgatctcgggctcttacacaagaattctcattactgtttataggatgagcgaggcagaggggaggcgaaaggctgtggccacctgctcctcacacatggtggttgtcagcctcttctatggggctgccatgtacacatacgtgctgcctcattcttaccacacccctgagcaggacaaagctgtatctgccttctacaccatcctcactcccatgctcaatccactcatttacagccttaggaacaaggatgtcacgggggccctacagaaggttgttgggaggtgtgtgtcctcaggaaaggtaaccactttctaaacaaattgcatatgctgctagagacttgaaatgaaggatacaagactttatcattgcccttgagtttaaatattctctgcctggaaacaagtgacccacatgccagcaactgtggggcatttatgggatttggaaagctgcctgggatttttaaggatttcatttttttgaaaggtatgaaggctctgaacaatgaacagtttgggctggggtaggcataaagctgaggtttagtagtcacccatgagctcttaacaaggtgtgtattccactaaaaatcatggactagcctgtttctggctctgctcagtcatggcaaaaacggtcatcttcaactacttccctgacttctctcgacttttcccctttagacagtctgtccattgaccattataaagaatcaactcaaatattatatttcaaatatagcagtcaccatcttatcctcaggctgtgttctaagtcttttgggggaagcctgaaaccatagtatagaactatagaacctgactgctgtcagtcacaacatatttgctcatcttctaccataaatgtaatacgttttctttcttacctaagcacttatcacacactgtggctgtaggttttgcagtttgaggtgtgacagcaaaattaccacaaatgtgtttttcctcctacacaatttcaaagaagattcattcttactgtagatcttggcaatctcagcatatttttcttgccagaacctccagttaagaacttattagaatgtgtctctgataatggtttggctgtttccccacccaaatatcatcttgaattgtagctcctataatccccatgtgtagtgggaggggcctggtgggagttaattgaatcctgggggtgggtttttcccatgctgttctcatgatgaataagtctcacgagatctgatggttttacaaagggtggttcccctgcacatgagtcttgcctgctgccatgtaagacatgcctttgcttctccttcaccttccaccattggctgtgaggcctccccagccatgtggaactgagcccacttaacctcttcataaattacccagtttggggtgttttatagcagtgtgaaaatggattaatagtctgtttttcagagacatgagcagagggccaatatctttagaaatatagaacacttaaaaattaagtcttataggagctagcaaggttttgccaaatacagattcacccaaaaatgtcaagtggcactttggaatggagtgagagtgggcaggcagaattatctgaaattaaaacaatctaaactccaaactgtgggagtcagtcttggcttgtagcaaccaagtctatacctactgatgatataaaaaggattacttcctgaagagagttaaagggaaggaaaagagaaaaagtgaataagaaacatggaagattgagacaccacaaaatacctcttgtaaaaagtctaaattatataagataactaagttcaacactagacaaagtattgtgacacatgaacatgagttagaaactaataccaatcaatacactgttcacaggtctgttttttccttaagttgggcttgtattaacaattttccaaactgatacagcagcacttctcaaacgctttcatgacataactataaaaattagtgatatggcaccttgaggaaaactgatgtggctgttgacagcaaaatcaactcccctgtggctgtagccaaatcgggcactgaagaccaatccagggttgagaggatcaatattggttgtaacccatttgtggctctggagaaagacacatcacaccagagggaagagtgtatccaatcaatccaatagttagttggagaactttatttatggatgacatataaaatattcaggaattattgaataacattctaaaggctgaaaaagggtatgggttttctgcttatctgcaacagagggtataaggtatgtgtccaatggatttgtgatgactagcaatcataagtaatgttgcccattagctgacttaatgcatgaaaagcattcaatgatgttgtttgggaagcagaactttagtaataagaccaccttcttttccccattagagaaataaatgttaggaagttcaattttcctaatgtttaaatatcttaatgtgctctggtgaaaactttagaaaatgcataacttgtattaccctcacttttttctctaccaattgcgttatttccatcatttttcttatgtctcctttattcctactgaggtcaatattcttctgtagtacacgtaagacaaataattctgaaaaacacttaacctaagtgacaaatgccacttttgtgaaaatagaagataggagaaagtagaaggaaaatctcttgggacccaaactcactaagccaaagggaaaagtcaagcttgggaactctgtcatgcaaaactatattccatatctgttcccgactgtatggctacagattccatactgttccggaatggacagctacacaggtagaaggctacatacctccccaagggacctccctcacaatctgctagcaaggaaattccttgctggcccaaagatctttacccgaaaaccattctcttgaattgtcatgctgacaatgtaaatgaatggcttatcttgacaggcagtggacaaagacaggcctgggagtcatccctccactcccctgaaacaaatgcatatttgactgcttcctctactgtgtaccttatcttatatacaatccagattcactgagcaggagatgaacgcccagttgagtgttcctctaaaccctctcctgtcacatctaaagtgcgaattcagtcaacactgattaaagcctgcaaagaaggaaactacttcatttattcacacttcctttttcttttttttcctctaatgcccactgtttcccttttaaatattgaagtctcccaaccgtctttggaagaagcacaaatctcagatgctcctgtcatattgtgttcctttttcccaggtgcatcctcaaccttggcaccagaaacatctacattgattgagacttggctccaatgctttttggttcacacttatttataactttaaagatttctccccaaacaagaggccagtgacttttgagaaagagcttttttagtttgtcatagcctctatttctaaagaaatttaaaatctaattttcaatttagagcgaggctcttatccccacatcactgcctttaaaatctctctggagagatgccaagattcagtaagacattttcatgatgaaataccaagaaacgattccagtccttcacttgggaaaacaatgcaccctctgcaagaaaggacaggctgcttctaaagttcatggtaaacccagtcaacttggattaattgctaacccaggaattcttcctgggggatgtgggactctattagtgaaaagactttttgacctagcctcacccctacacaatgtatttaataagaagtctgacattccactactgctttagaaagacttggacccagcttctctgaggtaggatccttagatcttcatgaaaaacagaacatcacccagatactgggatgttttcttcaggtattactctgtaactattagaaggccacgttactactgtgagcttatctgctaataactgaggcagtggtcttctcaagattaagcataaataacatatattcactatctggcaagcagacaactggaaaagggcatttagcatgaaacgtgggaagctaagggaaatgtaatagtttagaagaacatgaatagatttactgaaggaaaatggcatgtaagagccgacagttagaagaatgtgcttggtattcacaatgagaaagtttcagaattaattggtagcaggggtgcatactattggataagcatagattgccctctgaatattttgttaaaattttaatttacattttaagttaaatgattaattgctccgttcatatgcatttaggtgtggctgaagacttcatgcttggagggaaatcatgatttttttttttcattttaacctccttcctcttttattgaacccataaggcatccacgtgtgccttaagatctttttttttaataaaactattagaggtctcctagaagccatcttagcatggcatataaaagcctgttgagctgagtaactggagcccagggggagatgtggacatgttggaagctcaggctgtaggggtataataatgagtgcattgtgtttatagttgcaggtgtctgccccttgcttcagctcacctcacctcaccactgctgttcctgtgtaatcctccatgcccttactctccatttcctcttccacagtattagtagggtggactagatgggctcgcctcgcctcacctcgcctctgctgctcctgtgtaatcctccattcccttactctccatttcctcttccacagcgttagcagggtggactggatgggccatatgccagatcctttgatttctatttgccaccacacgaactgacactgctgcccagaagcattcccctgcacatccacatcacagccctcctgctggcagcttggaatttagaccttttactctcaatgctccaggaaaccagatgtacttctttctttcttgtccattggtgatatccttgacaatgtagtttaggtaagttggcatgtagcattaaaacctgtattcttcaaactgaactaacttctggcatagtaagtgttcagtaaatgttcacctacatgccattatagtgctgattttttttttttttttaaagccaagaaaacttctatcttatgcctaattttccacactgaaaatttccaaattgtcagttgggatgggagggaaagtagactacttttccatgaatgaaaacagttaccatttaaataaataggcagataaaggggggtggtaactaaggcagtatgtaattagaactggagataaggtaagggaaaagagaaattcacatcattggatactacgttgctgtggagagaaggggataaaatctgattaatgtaggaagcaaggtccaaatgcgttcattcataaaagcagacggagtacaggagtagcttgtgtaggtagaagaagaaaaggagttcctggccaaagcccactgtggctatgaacacttatgagtagcaattaatattaatcttgctttcaagactaaaactgccaggtggatctttcataagtaccttatttcagcatgtaactttctgactgaaacaactcccatttgcaccttatttctcgacgctgagttctggtctccctgccttcactttccagccgcactccaccccacacacctcagctctccacgggctcttcagctgtagttagactggactctcccctctctcttccacccctagtgcctgctaattcccatttgcgagccttttgacattatttacattgtctctgatcatgtcctctctccttcagtctcgagtttcggaatcagaccggtttccctctctactattgcactgtttaactgaactgactcctgtcttctcctggttcttgtgatccactattttcaaagcagtgatcacttagatgctctttaaaagtttcatgctttaagatcctttcagtctctagccctagggttgaacctttgaggtaaagaattctgacatggtattcctctctttaacactttcatttccatagttttagttaacctgcaatccgccaggttgctatctaccatgtgtagaaaatattaaatgaaaaatctcaaattttaaattgcccaccattttgagtagtgtggtggaaatatcatccctctgtgtagttgattcacactgtctatgctaccccctgagtcattcagtagctgtctaggttatcaaatcgactgtggcggactcagtgcttgtgttcaagtaactcagtttttcttaatggctccaaagagatggagttagtgaagctggcgatttagatgtgccaaagagaggctgtaaggtgcttgctttaactaaaaaggtgaaagttcttgacttaaggagagagaaaccctcataagctgactttgccaagatctatattaagaaaaactttatctttgaaatcatgaaggaaaaaattatgcaagttttgctgtcacatcaaactgaaaaagttatagccacagtatattgtcttaggtattctattttattattgttaatctcttactgtgcctaacttataaattcaacttgatcataggtatgtatgcatgggataaaatatggtatatatatagggctcagtactgtctgcagttccagatatccagtgggggtcttgaaaactgtctcccactgataaggggaaactgtacctttgtccactactcaaactgatgcatagcatcttctggtttgctatgacttcatgtatgtaaaacttctaaagtacctggcacacgtaaagccctattggtttatggtttggggaataccaaacttcctgtttctcttcctccgtctcttagtgccttccacaccattatcttctctcataagctttaatcaaagcagaaagatcccaatatactatccttggccccctttttctcattcaggaacaaataatcgatgactcttagagctatgtggcacttaggattagtaacatgttggtgacatgccattcttttactgaaagaacactgaggtctggagaagtaactatgcgtgtcatccccagagcaatttgacagctgagcaaagcacaatggcattagctgttatttgtggctaaacacctttaaaaagtccccaatatattttcatttttagaaatccccactttagacttaaaatgatctgtttctatgaggatttttgatatgatacattaatcaaacttaactatgtgccccttaagaatattgtcagttctatcaatcttcatagctcacccagtgctaggtgagtgttttgaacacggaatgtgtttgtgcttcaggcattctgtctctaaggatggaatggaaaacccttccctttcaagctttacaggtacgttgtgtcaagtggagaagatcagttctggttagcagctttattgccacagaaaggacactggcagatacttctcatagctctagtcatgctgaattcccggaaaggggtgtcagaatgaattgctctaagctcttctccctggtagaagaacctgtgacttctcttggagatctcttcaattttcggtgagtcaccaattgttcttgatttctatggcttctcccagaacaactccagggctgttgtcctgaaacatacagctttgatcacctggcaccctgcagagattctcctttccctcttctccatgtggcagaccacaggtagaataaatgcctcttggcgagctcactcatccctcatccatcagccccaagtgtgcagataacagatgtggagctcctgtgcttggtgtcctccacctctcggcttgatcttcccaccctcccattcctgccagatgattatgttgcaacactgggtgatgttataactggtcctgggggtcaggggttctgggttatgttctaatctgcactggggagaaatcattcaccgccttgaagagcctgaagctttgatcacgcaaataaaagctttttctttttctttttctttttctttttttttttttttggaaagactagttgatgaaggggaacctaagtgtcttagagtggagaatgatgatagtgagggaaagatgacctgatggggaatggaatctaggatcttgtatgtgtgaataagtcaaaccacacatcgtaatgctaaatagcatcaactctaatgttaaaatgtagatgctcggaactgatgtaaacagaagtaactgatgacatgttttgtccataatgcagatattttccctgtctacttgcaatgcccagtagcctatggaataacattaggcatgcatttgaacatgtcacatttggttctaaatattggcttcattgaaatgggtgaattgctcgtttgtgccaagcagtgtagttctgctctttagcagggccttttccctacacatatccccacccactcacagatgcacacaccacacataccatgctcacacactcacatatgaacacactacacacacatgtacacacaacgctcacactcacaaggaacctctttttttttttttaacacggtctcggttgtataaaaatgaggtggctaaaatcatatctttctcctgtttcagcttttttactctcctcttctgggatcctacagtaagataagatctaggagttgaaaacgttcttatccttttatcatagacatttgaggcaatagtgttttacctcctctttgaataccttgtggagtctgattatttacatgaaacaaaatgctctggttcatgttctgattcaaaagtaattggttattttcttaggtcattttcgtttgtctcattcttgcctatttcagttcctcaaagtatatttttaaaaggatgattgtcagctaacctaacactatagtaattaatgtataatatccataatgcatttaactgaaacaatagatgtgggtcaagacaaacttactgtctgcgagattaatatttttaatttccaacaagctattgcaaaagccactgcaaatggaattgtatatttaaatagtctcttgacccatgattcgaagctgtggctatcacaagaaaatctttcacctgttagagaaggcaaaagtagctgacttttatcacgcttgacaggagttaatatttgatgctcatgtatttttttctcctcaaccaaggtgtgacaaactgaagtttcagcacagaccaacacaaaaattgcttttttttctttctccctttggatgtttattcatcttttaggcctattactcatatctccatctctgagcactaagaaggaaaactctactgttgctattgtttttgcttcaacataaggagagtttattccttgatgcttcagggactgtaaattttgactattctagaaccaaaagattcagatacatttgtagtattggtggccaaaacgtttgacagaaaacaagtttcttcagtaatcctgtcactaaaatgagaagaaatacaccataatctaataaagaaaaattcatccctcagtattcctgaacatataaaagggacacacattcatattactcaaaaaagcatgagaattcattccattgattcaaggaatgtttgatactgctgtgtcgcgtctgagttcagaaatttctttaccatctatagtttttgttttcttgttttgttttttgagacaaagtcttactcttgtcccccaggctggagtgcaatggcacgatctcagctcactgcaacctccgcctctcaagttcaagcgattctccttcctcagcctcctgagtagctgggattgtacaggcacctgccaccatgcccgattaatctttgtatttttagtagagatgaggtttcaccatgttggccaggctggtctcgaagtcctgacctcaagtgatctgcctgcctcggccacccaaagtgctaggatcacgggtgggagccactgcacccgactgtagttatttttacttataaacatgaaggatcagtaaaatggtagagaaataaacttgaggaaaaaacccaagtagcagtggattactaggatgatataatattaggacaggttcaggatgccactctgtcagagaaactctaacattttggctaaacaatattttaagatgaggtcatgattgaattctatgatgcagcatctaaattttagcagaattcattgtcaactggaaagaccaccaggataacgaaactaaagccctgttctgaagcagtttgtggtggttgtcctgccagatttatgatccccaaattattctgtgagaacaaatagacacaagttctcacagcagtccatgcctaaaagatgaactccttttgcaggacaaaagtctaaccacaagacagtgtggctcctgaccccaaatgaggtcatctgtactgctttgatgttcctgactttcataaagctgttcagtaacaacagcagccaaaaaagtcagttatctagatgttttctatcaatttaagtcacaaatagacgtctgtggatgactctagtacaatcatctcgatggagatgcagagagcaatttaaattcaaatcatttcgctaggcgaaatgggaaataaggcacagtaaccaccctcagaaaactttcaatctaaaagtgataagattatgaaatgtattcagaagatagttcaaagtaaaaatcagattctaaaccaggtactgtatgaattacatttacatctcacatccagcctgtagagtacagaactatgatgacctttcacagatgatgaaattgagttgagattaattttctgtccaatatcatacagatcattaatactgaaacccaggatttcaaatgatcctgaagtaggtgatcttttcttgatctcacgctgcttctgacatactattcctggtgggctcttcctacatatcaggtcgttaaataagctgccagatttctgcctttacagcccaaggagcttgtcatggaccatgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctagcagggactcccacagcatcagagtggtgactgtgatcgggaaggattagcggggactcccagagcatcaggggtggtgactgatcaggaaggactagcaaggactagcgcaaacatctgcggtgctgcggccaataacgcagctattacagaaaatatggtattggttctgaagaatgttcagtgtcactttcagcaattcaaaattaacaggcaaaatcatcctgttgcaaggattacttaggaacagtagcgaagttggtgagcatctccgcattagtcaactttgttcaactggattcacaaacatttccagagggcattctcagtcaagtagccctacaaaccattcatggcacgccaagcagctcttggaagtgcccatgttaacatgtgaccatgagtccttcctgtctgtattgctaacgtgtgatcatgagtcctgcctgcctgtattgctgacgtgtgatcatgagtcctgcctgtctgtattgctaacgtgtgatgagtccttctgtgtctgtattgctaacgtgtgatcgtgagtccttcctgtctatattgctaatgtgtgaccatgagtcctgcctgtctgtattgctaacgtgtgaccatgagtcctgcctgtctgtattgctaacgtgtgatcatgggtcctgcctgtctgtattgctaacgtgtgatcatgggtcctgcctgtctgtattgctaacacgtgattgagtcctgcctgtctctattgttaacctgtgatcatgagtcctgcctgtctgtctgtattgctgaccaacttttgaatggaaattggaaggagcatttgccacctccttgatgacttaatttcaaacattcaatacaagtaaaatattttctagtgctaaatgtgtagcaattttattagaaaacatttaggaaggtgatactatttttggttccatgttcttagttacattttatgaatgttatcacttacctctgaaattaaatacttgccctgcctttattcacatggagtccaatatattcctggaaatattgattcattgattgaaaattgactctgccattaagattgttacatggccaaaaacctacaaaactgccatttatgctcaaattgttaatagataaatgtagaatgaataaaccaagacattttattagctaacttagttcccgtggaataagttgctcaattttcttattctcaacatcttcattgatatgctgaagacaagtatttttgtaattagttggagttaggtgtggtgctttgatagatgtgtaactttggtggaatactaactaagcaaagactacactgaccccaccattcatgtaactttagtttctcctgtgtgtaaggtcctgaaatatgagacataaaaaatattgacggacctggtgtttattttctttgttgatacgaggcttagaaaacattggacagagcggttacatagttgacaaagactaagcaaaggttactcagccttatgttgttctagtgtcaacacagatagaaggaaaaatgtttcctccattgttgctgacgtagataaagaatattcccttcaatatgctaacccctaggtggcttttcattcagaaggttcctaataatttgatctttaccctgaaatcaaacacatggaaaagagatggaagaatgtcctggagggattaagtgaagaaacagaccaggattcatttatgaaatatcctcggtgttatttcaattcagctccattcacattttattcttttgtgtctctgcactaatgccctccatattctccattctcctgccttagctagcaccttctcgatcttccctctacaaaactccttcagttcacattgcatttgtgctctatcctgggatatgtgttttctttcccatttcctcagttgctatgtattaaaaattaggacttttattcttatgtttccaagattaattctttgcatatttaactagaatatttaactctaacattgacagacatttcaagagtatacctgaagcaataagcgaaatgcattttgacaagtttctagggatatcatggacattagtgatcggggcatggaaggaggtgacttattcaatgtttgagtctatttaacaaatttcatggtggttacatcaacgtgttcttttcctggtgatttatcaatctttccactgttgatgtgtgtgcttttctgttaggctctactttaatacaacttaaaaaaaaattttaatctcattttacacatggtgtgtatccactcccttcacacataaaactagtcccactgtaaaagggagtgaccaaggatttttccccagtcatctcaccaaattcttacataaggtaatttgtggtcaccagatttgcttctttattaaaataatatataaattttaatattgagtaatacacatcatatttaagttactaaattatcagttgtatacctgaaacatggcatgcactaatccaggtaatgaggaaaaaatagaagactgtccctagttttgaaaacatttaactacattacctgattttgattctgatcttcacaaattcttataaagtatttagagaaagaattagccccatgggagatgaagaagctgatgttcacagcaaattattgccccattccagcaagaggcagatggggcttcagaaccacgtcttctaacctctggtctggtgttttgtgccaagccatgatactgataaacaatttacaaatgagagaagtggctgggcatggtggctcatgcctgtaatctcagcactttgggaggccgaggcagttggatcacttgaggccaggagttcgagaccagcctggccaacatggcgaaaccctgtctctactaaaaatacaaaaaattaactgggcgtggtggcacatgcctgtaatcccagctacttggtaggtgaggcaggagaatcgcttgaactcagagtggaggttacagtgagtcaagattgtgccactgcactccagccttggcaacagagcaagactgtctcaaaaacaaaacaaaggggagaagcacatggcacaatgtgtatctgccagcttgttaaccctaataatgacctggggacaaaggtcccttcagagcaacatgctgataaaagccatgttcatttgctgttggatgctagttaggctggtctagccaaggacctgatgacccacattgaggggtaatcagattccctgtggggtctttctgcaggtaagggatatggatataaaattaacttgcttctacagacttgttttatacaataaacatctatatgcaatataaaattgtaatagaagaaagcataaagtctacttattaaataccttattaactgctttattcaatgctcaggaagatatcaggcaaaaaggaatgatcagagaaactgaagataattagataattatttagcgtaaagaaaacaaaatgcagacctctgtatccacaaaaattaaaaatctgaaaaagtgacagaacatccctgtcaagttggacaactgactttaaatgaagtgaagttctgctaaagaattctgacaattctgtgaaaacaaaatgactgaaatgtcaggtcctgactctacaaagaagttccatacataaagcaattgtattcatagacaactttatggcatcgataggttatttagttaaaacaacaggctgattcacacacaaatgataaaaaccagatgcatttttaagcttctttttcagctgtgattgtactgaggatggatttcttaaacctgggtgactcccgtgaccatgtcacacacttagcagcatttcactgtgtgcttccttctaaatcccaggtaataaaggccaggaaaatacttggtttgttttgactacattcctttggtttatacaactagcaaagaatataaaatggtaaatacctgtagcttgaactctggttgtttcacattgtattttttatgagcactttaagcttatttggttttattaaatcatcacatacctaaaaacaagaattgttaggcatcgcaagcacttaaaatttttcctaatacagaatttgcccttaataaatactagtgtaataaatgaatgaaaaactttcattttagaaggcttagtaccttttaaaaatctttaaaagaaagtttccttggcatctcaggtttgaagagacgacgtggaaactgaagattaacaaagttagacttttataggctcacatagaactgcatgtcaagggtgatgctagaagcaaaaaaacaccaaaaaactaaaattatttccagcttcactgataagtggtttaactattttaaaattggagcttatgtaaaaaagtcattggcttttgctagattcttcatatattccttctttgaagcaaacaggaggtaagtcccattaaggggcatttctcaagggtagaagcagaaaacactttcatgactgaaaatttaaatgcaaagtttaggattacatatgtcagttgatgttatcaaaattgttctttccctggatttccaaagtgtttaattgaaatgaccagtgatgttaatgaagtattctataaacttggaaaaattaaaatcagaaaacatgtttgaacatagttaaaaccatatctttgggcctcagcttctgaatagctgaaggtttaatgaagagaactgcttttctgtctccctgtataaactggggaaactacttcaaagggagaaaggataatatagtcttggcccaaggcagggatgcttgcaaataatggctttgtgtaatttgaaagattgtaaaaatctttaccttttttgattatctttgaaatgaaatcccttaatacatacacagcatgtattataatcttgttcttagaaatagagaatacagttgtaaggagatgattatataggttgaaaatatgccaccttttcacttaagaatacaatgaacctgctataggatgaagaatgaacatagatcacctcacattccactggtcacttagaattctattatgtactaaaacctaaattatttagtacgtgtccagttagcagacgcttaggttacttccactttcttattgcaaataacaccggaatgcacttttttaataaattgcccactcatctgattatttccatactacgcttccctaggagcggaagcttgtacgtattttttaaactcctggcattgactcagtgcacgctctcaaaccagaaaacaagacagaaaacccattgtaattcccaccagcagtttgagattcccccctttatcctcgatgttgatacaacccagctctcatgtagaagttcaagttgaataagattgactgaaactctatttctgcactgtggcccttctacattgctatcctattgaggaagcttcgtgggctcatgctctaggtaagaataaaattaagttcaagccctctgcctctggcaatccaaggcccagctgagtagatctgcatgtcattgcatttcatcgccttgcaagagtaagaagaatgtgaccctaactgtgcagtgatagacacgtattaagagggagggatgagttgttttcatgactccacctaagagaggcctgaaaagaccgcttgattggcaagaggccaaaaacagcgttaattttccaaagatgtttagttcaataacgaagtctagataatctggctcaagtcgtgaataatcatttcagaaatggtccctcaactgtccccaatccacagcagggagactctcctgtaacttagttcccccaaactcccaactttagggaacttctaagaaagtgatctagtgtgttacaacaaaagtaaacatcaccataagaatataaagtctgactacacagttggcccttcaaattatcttttaaaaaaatctgtccattagaggtcttcagtacctaggaaaatataggatacgaggacaattatgttgaaaaattatcataatttaactcattgtttcattgctttggctaggactttcagtaccatgttaaatagaactggtgacaatggacatcctcactttgtaccagaccataggagaaacattttcattttttattaactgtgggcttttcttatatgatgtgttgaactaagttccttctatacctgtttttcagagtttttacatgaattgtcaaatgtttttgctgcaaatttttttattctcttaatgtgttatatcacactgattgatttgcctatgttgaagcattcttgcatcccagagatacatttcagttggctatggtttattctctttttaatgggctgttgaatttggtttgttagtattttgttgaagatttttacacctatgtttatcagtgatattgacctgcagttttatttgcttgtgattatctttgtctggctttgatataagtgtatgatggcctcataaaatgagtttggggcgttctctcctggtttttgaaagagtttaagaaggattgctattcttctttgaatgtttagaattcatccacgaagccatttggttctggtcttttctctgggaatcttttgtttactaatttgttcttattggtctgttcaggcttcctatttcctctttagttttggtaggttgtataaatcaagaagtttgatttcttatagattatctaatttataagtgcataattttcataatagtcttttatgatccttttcattttgaggcatttgttctaatgactcctcctatttctcattttagtttaggatactttttttcttagtctagctaaggtttatcaccttttaatttttaaatagttttgctgatttttctagtttttccagtctcctatttctactttaatattttattctctatgataactttggacttaggctttctgtttctagtttcttgaggtaaaaagttggttaatttgaattttttctttcatgtggctattcgttgcaatcaacttttctcttagtactggatttggtgcatgtcataagttttagtatattgtattttttgtttgtcttgagattttaattctcctttgatttttccttttgcccagtcattgctcaatttaatggtatgtatgttaacacaccaatatgtgatagagcacataaacctccaaattactaaagttataaaagatttatacaacatacttaatggcaacaaaacttgtagatatgaatgctcacaacaataagaaaagtccacgttattttctagtgcacatgggattctcaccaaaatcaatcacaggtgggcctttgacagaataatataaacacgacataaaacgtgtaggatgcagctaaaccagtggttacagaaaaatttgtccccatagatcattaagaagaaaggaagcctaaatattgactaatctcctaattcaagaagatagaataaaaaaattcaaattatatctataaaatgtgaaaaaaggatgaagtagacaccatctatatataaatgtgtgtagaaatcatagattaatattcatgtttctgatttcagttccagatcaaaatgtctataatcatttttccactttcatgttctttttgcattattttaaaaaatatttttaattgaaatattaaaatacatattttatggggtacaatgtgatattttgatacatgtatattatttgtaatgatggaattaacctaaagaacatatcaccaattttcatggtgagacatttaaaatgtacccacttagcaattttgatatatacaacacatatattacatatataattataattttgtattatatataatatacattatacacataaacatgtatatatgatatatacaattataatattttgatacatacaacacaatatccaactttgatacaaatgaacaagattttcttctatttaaaggctgaattacatttcactgtggatatatgtcttgttttctatatctattcacccattgatggatacttaggttgattccatatcttggctattgtgaataatgttgcaatgaacatgggagtgcagatatctctttgacatacccatttaaattggatacatccttattaatggaattcctgaatcataaggggttcatactattaaggcctgcatcaaaaagtctgaaagagcacaaataggcaatctaaggtcacacctcaaggaactagaaaaacaagaacaaaccaaacccaaacccagcagaagaaaagaaatagcaaaaatcagcgcagaactaaatgaaattgaaacaaaaaatacaaaagctacatgaaacaatgttggttctttgaaaaaaataagtaaaattgatactgttagcaagattaatcaggagaatagtcaaataagctcaactagaaatgaaacaggtgatatgacaaccaatatcacagaaatacaaaagcttattggtggctactatgaacacctttatgcgtgtaaaatagaaaacctacagatgatttaatttctgtaaatatacaatgctcctagattaaaccaggaagaaatagaaactttgaagagaccagtaacaagcagcaagattggaatggtaattaaaaaatgccaacaaaaaaagtctggggccagatggattcacagctgaattaattggcatcaatcctactgacactattccacaagatagagagggaaaccttcctagatcattctatgaagtcagtattgccctaataccaaacccaggaaaggacataacaaaaccatagaccaatatccctgatgaacatacatgcaaaaattctcaacaaaatactatctaacagaatccaacagcatatcaaaaagataaatcatcatgatcaagtgggtttcataacagggattcagggatggtttaacatatacaagtcaatacatgtgatacatcacataaccatgtgacttgtgtttttaattgtgtttatctcaatagttgcagaaaaagcatttgacaaaatccatccctttatgattaaaaccctcagcacaatcagcatacaagggacatgctgtaaggtaataaaagtcacctatgacaaacccacagcaaacattattctgaatggggaaaagttgaaggcattccctgtgagaactggaacaagacaaggatgcccatttttgccacttatattcaatatagttctggaagtcctagccagagcaatcagacaagagaaagaagtaaagggcatccaaatcagtaaagaggaagttatgctatcggtttgctgataatatgatcgtataccaagaaaaccctaaagactcatccaaaaagctcctggaactggtaaatgaagtcagcaaagtttcagaatacaaaattaatgtacacgactcagtagctctgttaatacagcaatagctaccaagctgagattcaaatcaagagctcaacccaatttacaatagctgcaaaataaaatacttaggaatacctaaccaaggaggtaaaagacctctatgaggaaaactacaaatcactgctgaaagagatcgtagatgacacaaataaattgaaacacatcccatgctcgtgggtaggtagaatcaataattgaaaatgaccatattgccaaagcaatggacaaattcaatgcacttcccatcaatacaccaccatcattcttcacagaacaacaatcctaaaattcatatggaaccaaaaagcccacatagccaaagcaagactaggaaaaaaagaacgaaaccagaggcatcacattactcgacttcaaactatactataaggccatagtcaccaaaatagcttggtactggcataaaaatcagtatatagaccaatggaacagtatagagaacccagaaataaaaccaaatactatagccaactgatcttcaacaaagcaaacaaaaacataaaagtgggggaaaggacaccctattcaacaaatggtgctgagaaaattggcaagccacatgtaaagaatgaaactggaacctcatctgtaaccttatagaaaaaacaactcaagatagatcagacttaaacctaagacctgaaattattaaaattctagaagataacatcagaaaatgttatcttgtagacattggcttaggcaaagacttcatgaccaagaacccaaaagcaaatgcaataaaaacaaaaataaatgagacttaattaaactaaaaggcttgtgcacagcaaaagacataatcatcagagtaaacagacaacccatggagtgggagaaaatcttcagtctctacatccaacaaaggactaatatctagaatctacaagaaactcaaatcagcaagaacaaaacaaagccattaaaaagtgggctaaggacacaaatagacaattctcaagagaaaatatacaaatggccaacaaacatgaaaaaaatgctcaacatcactaattatcagggaaatgaaattcaaaaccacaatgcaataccatctcactcctgcaagaatggccataatcaaaaaatctttaaaaaatagacattggtatggatgtgctgaaaagagaacacttttatactgctggtgcaaatgtaaacttgtacaaccactatggaaaagtctggagattccttaaagatctaaaagtatatctaccatttgatccagcaatcccactactgggtatctacccaaaggaaaataaatcattacacgaaaaagatacttgcacacatgttcacagcaccacacttcacaattgcaaaaatatggaagcagcccaaatgatcatcaatcaatgagtagataaaatcatatatattcatatattcacacatatactcatatattcatatatattcatatattcacacatatactcatatattcatatatactcatatattcatatatactcatattcatatatactcatatattcatatatactcatatatcttcatatgtatatagatgaatgctacttaaccatgaaaaggaatgaaataatggcatttgcagcaaactggatggaattagagaccgttattctaagtgaagcaactcaggaatgaaaaaccaaacattgtatgttctcactcacacgtgggaggtaagctatgaggatgcaaagggataataatgatacaatagactttggggacttgggggaaagggtggaagcaggtgagggataaaagactacacatcaggtacagtgtacactacttgggtgatgagtgcaccaaattctcaaattgccatgaaagaacttattaatgtaaccaaacaccaccggttccccaaaaacctattgatataaaaaatataaataaatatcatatatatatcatccaggggcagtagcttatgcctataatcccaacactttggaaggctgaggtggaaggattgctttagcctgggtatttgagaccagcctgggtaacatagtgagacctcatctctccaaaaattaaattttaaaaaatcagggaggcatagtggcacgtgtctatagtcctagctactcaggaggctgaggtgagaggatcgcttgagcccgggagattgaagctgcagtgagccacaattgcgaaactgcactccagcctgggttgacaaagcaagaccctgactcaaaaacagggcggtatatattttacagatacatcaaagtcttatctgtgctctcttgaattccctctcttagtgtcctcagaccaatttttttaaacaggtgtgtatcttccctatcaatttttaatatttttattgcagatatgtgtccaaatgtaatattttagtaggatgtatttgttaaatggtaacacactgatcattctgcaacatattttccttcaactttactaattgaaatgttcacaataaattggtattaatattgatcatgtgtgcattttctttatattaatatttaggtttaccactttttcatgctttataatgtaagagtatctatccttgtataatctccttggaagtcttaggtagtgaagaaagaacatcttcaatgttatgagatattactgaattcatctctaaaggagttgcactaatctctctaaccatcatttttccttcttcatttatttaacaaataatcaatttttactattatgttggtgcaaaagtgatatatgccaggcatagtgctaatgttagaaaacaacagagaagaaaataaatatattttggtctccttgtgcaataacaaaaacccaaacagtgaataggtaaaacatacgatgtggtcatgccagatgatgatatgttatgaacataaaatagggaacactgttgcaaattttaaatataattatggatcagtcagaatgcacaaggtaatgccatagtaacatctcaagctgcataaaaacattgtttatgtgatgttcacattgtaaatctgtcagatggtactcggggtccactcatcaaaagtccctcaaggacctaagatgatggataactttgttgaccattttgtcattttatgttctagaatatgtttatatttgtggctatacatgaagcttgtacaactattgaagtatatccataaaaaaaataagtgtacagctcattaaggatttcatagcagtacctaaaatgtatctagaattttgcaattttacatattaataaccctccacctgccatttttaaatgcttatttagatttctaactttcatacctatacagcatttggatagcccattaatttttaattatacatattcatgtggaattttcattgaaacttaggaataattaaaatacaagagtgagttgaagcttgtgtgaagagtacaaaagaaggattgtgatgtctgaggtgtgagagttctcactgattgagtagagcacgccttcataaagaaattgtcatattatctgagcatttatgactggtagtttatatagaaatgcatttggtaaattcacagcaaagaagcaggatacgagaagttatgaaggaatatgaaagtgtgtggtttaaagatactctgagatattggaagaagcaatgttggaagacagggtgggtaccagccaaggacagaatatgctcattctgtctcctggtgtcagtatctgcttctgcagttgggcttatgagttggattctgcatctgaggattcaaccaatcatggacttaaccaatcatggattgaaaatataattaggcttatcatggtcacattggtacagacttttctaaattttatttttgttgtgacataggtgtatacatttatggggtacatgagatgttttgatacaggaatgcaatgcataataaatgcatgatgaaaaatggagtatcctctcaagcatttatcttttgtgttataattttattatacccttttagttatttttaagtgtacaattaaattgttattgacgatgtcagtctattatgctagtacttattcattctaacaaatttgttgtatccattaaccatccccacctaccccttcaccacccccagtacccttcccagtatctgctaagcatatttctaatttatatctccatgagtccagttgtttcgattttaaggtgccagaaataactgagaacatgcaatgtttgtctttctgtgcctggcttatttgacttagcataatggcctccagttccatctatgttgttgcaaatgacaggatctcattatgttttgtggctatatagtacctatcatgtataagtaccacattttctttacccattcatctgttgatggacacataggttgcttccaaattttagctattgtgaacagagctgcaacaaacatggaagtgtagatgtcttttcagtatattgatttcttttcttttgggtatatacccagcagcgggattgctggatgatacgttagctctattcttagttttttcgaggaacctccaaactgttctctgttgcacctttaaatacaactttaaatgcaacttcacattcccacagagtttatgagggttcccttttctccatgtcctcaccagcatttatttttgcatgtcttttgtataagagccattttaattgggatgagatggtatctcattgtagctttgatcagcatttctctgatcaatgttgagcactttttatgtgcctgtttttgatttgtatgttgtcttttgagaaatgtctattcaatcttttatcaatatataaatcagattattagattttttcctatagatttatttgagctccctatgtattgtggttattaattccttgtcaggtgtgtagtttgaaaacattttcttccattttgtgggatgtctcttcgttgatttatttccttcactgtgcagaagctttttaacataatgtgctctcctttgtccatgtttgctttggttgcctgtgttatggagtattactcaagaaatatttgcccagacaaatatcctggagattttctccaacgttttcttctggtagtttcatagtttgagttcttaaagtctttagtccattttgactatatctttgtatatggcgagagacgggactagtttcatttttcttcatatagatatccacttttcccagtacagcttattgaagagacgatcttttccctggtgtatgttccttgcacctttgtagaaaatgagttcactgtaggtatgtggatttgtttctgagtattcggttttattggtctatgtatctgtgtttatgccagaaccatgctgttttggttatggtagctctgttgtagtataatttgaagtcaggcaatgggattcctccagttttggtgggttggttggttggtggttttgcttagaataattttggctcttctgggtgttttgtgctttcatacaaatgttaggatagtgtcttctatatctgtaagaaatgtcattggtattttgataaggataacattgaatctacagattgctttgagtactatggatattttaacaatattgattcttttggttcatgaatctggaatatgttttcatttttagtgtcctcttcaattattaatgctttatagtttatcattagagaactatttcacttctttggttaattcctatttaattttatttgtggctatcataaatgagattactttttaaatttgttttaatctatttgctattgacatatagaaatctgccttgtatcctgcaactttcctgaatttattagttctaataggtttttggggagactttaggtttttccaagtataaggtcctatcatctgtgaacgaagataattttacttttctttgaaatttgatgctatatctatatctctatatctatatctatctatatatatagatatatttacatatagatagatttatttatatttgtttctcttgtctgattgctctagctagaacttccagtaatatgttgaataacaatggtaacaatagttgcactaaagtgcaagactaagtctctcttaattttctttaattttctgtccactttcctcaagcagaaggagtcttgccccatagccaccatagctggtaatatgctgagtctcacccggagccagcatgcctcagagtttcacccaaggccctcatgactctagctggtatccaaccctgatgtggctgagctggtatccaagatgcaagacaaagtcctcctcactcttccctctcctctcctaaagcagaggaaagaggcctcttttggagccacaagccgtggaggctgaggttaggggatgagtttagctgccctggctggtgttttaacaggtcatgtgtcccccgagtccactggctctgggcccagattagcattaggatttgcagctcttgtggcctagactgcccttcaggtttgtctgtggctccagagccactttagcccttcatggtgaggcttgggtaactcaagttccaaacactgggattcgcaattcccttccagcaatggctggtttaaatgcgcccttcatggtgggtgtcagctgaatttggtctgggtcttctttctgctataagaagggcatcgctgagctcagtgtcttagaattgctggctctccctctccttagtgcacagagaagctctccataccacaccaccgctgctgggggatgaaggggtggtagtgtcagtgatgcaatactgtttttccaacttcttcaatgcctcattcagaaatatgaatttaactccatgtactgtgagtgctcacctgagttttggttcttgagaaggtgttttttgtgtagatagtttttaaattggtgttcttgcagggggatgatcagtggaaccttctattctgccatcttgctccatcctccagacttttttccttgtcattatttcctaaaaaatatagtataacagctatttacatagcattcatattgcattagttgttataagtaatctagacatgatttcaagcatacgggaagatttgtgtaggttatatagaaatactctgccatttcatattagggtctttagcatcatggattttggtattttcacgatgtcctggtactgaggacagatagtgagggatgactgtacacagggatgaatacactactcagtacttgtacgtttgtcatgctagaaagactcagcaaagtctcggaaccttgcaggcactgagaaaagtggctcccttttcccattctctttcattcccaaattatataatctaaattcgatgagactaatatttcaagggaagtctctgagcctttaaggagaggggcgatgtgggagaaggtcaccctgtcatggagaaatcttagaccacattcggtcatcagattcatagatgtcttaagagtcacagaagcatagcaagtacataacactccttttgattctgagaaagtgacactcagagcttttagtgtcttgactaagattacacaattaattggaagcaaatataataaatggtaaatgttttagaacctaaaaggttgtcagactccgatattttctcctgaatctgggaaagccccagctgtgttaatggagagtgtctacagatgcaacttttccccacgaaagatggctttgtagggccatttcaaaatatgtcaaatacatactttggggtggaatattttgattttcctcagggtctgctatctgtcatgtgatgctataccagagtcaggttggaatttggtatcttattgccactcagtctgttttgtcagtcttaggaactctatttcaatgttattgctggtcagttgtgcctaaattccaaaagatgggtgtaatgaagtgtgtctcccttcttatgtcctgcaattaagcttttcagctttcctgagattctcgtggcctagagggggtctgttcagttgattaggggtcttaggattttaaatttagtttacagacttctgacactggttttgcatgatcctccctttgtgaaattcagatttgcttttacaaagagagcttattttaaatgtctgatatgaaaatataattttaaactagaaaaatgaagttgtttaaaaaatgtgcaacgtcatgagaaagatggatttgcttttggatagatgcatcgcataaatgaaaaacatgtttaattcccacgtggaccgtgagtggaaagttagaatataaccatcaaaaacaaatagcaaaagaaaacaaaaataccaaaatagtggattctgagagggtcttaaagaaaatagaagctccaggaaagagacaatgccaagtacaggaaagatgaataagaaggaaaaaaaaaaaaaaaaaggaaaacaaggcaaagaattaagcaataaacactcatctcaattccctaatgtgaagaaactgacgatgtaattttctcattttcattctgaatttaaacccctttgctttggccttagaatggtgaaagcagcttcactgagctggcgtggcttagatttattgtctgatggaacagaaaagatggagcaaaaggtttgtgctctatgtgccgtgttcgtctctttgttgaaaggtgtcttgatgacctgtctcttcagtgctttataaaggggataagtaaggaacaaagatacctgactcttgttgctagctcttcataattctgactttaggtttcctgaagtcccagggtttttttttgttttgtctcttgttttgtgtgtgtgctttgtttttgttttgtttttttgtttttttgccctaggaacagtgcgttgtatttcactttgcatttccacatgcctcagtcactattagttttttcctcagcattatttctctaacctgcagtacagcaaccctgaggatgaccaaacctcagtcatggagctcctgactcttcattagtctagaagttagtgggctttttaactttgagacaattgtatcaagcatgattaaaacaatgcaactggaaaattaaaactgaaatattcagacaaagcagtcactgagcaaagctatgaatttatgggaggggatggtgattagtttgttatgcaaaggagatgcaggacaagaggatccctaggcttggttgcagggctgcggttttatgaaagattcaacacaactgcctcatgtgctttaacttcatttttcaatcactatgaacggaattttggacattttaggcatgatttttgggggataaatggtatcagcaaaatgaaaataaatattttgtttatatttcaactaaatacttgatatttagggcatctgcagcatttattgctgtgatttcttgtaaaaatatttctctgcctgacagttaataaattaaatgccttagatttcactggggactgggagagggctcactgtgcctactgctgctctcctgctcggcactagttctgcaccccaagctactctcctcaggcaggcgggactctccctctgctcctctgccccagtcagcactacttatggaatgcaaccttgtgaggaatagcagaataaattgaaaagttttcgtgaggaaagtggacttaaatggagatatataatggtagaagaaatttaaggagatttccagttttcagattatttcatggtattagttatgatatttgtaccattaacaatattaatattaaccttatcagccgtgatttccatcactgagtcctggatgagctactgtatccaaaaagtagtgaaaatttcaacccaacactaacactgtgttacagacctaacgtgcattccctacttcagtctctaaccatcccacaaggccagtatacttgtgttcttaattctggggggaaataagacatagagtgtacctgtcttcactcttgacttagctcatgaatagtcacctccccagatctgtttcgtagttcactttagcttgtggccaagatacaacttgacctaagatttgaacttatgattttatgtcagtttaaatcaatatttagaaaaataattcaaagcacatgtcttaccagaaaaaggtcaggaaagccatgtacataggaaagatttaaaattaatgacttttttttcctcagggggaaactgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccatcatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtagtaaagggcaagcattgtcccctcctctttctataattccgttactccctatctctcctctcttttgccctcaggtctccgggtccccagcacaaagcccactcatattttccttctttcttatacgtggcgttttccctccatactgcttattgctcccatttatctcattagatttaatatctttagagtgtttttaactgcactgcagtagctgacctatgaaagaccttatagagtgccttttatcttatctcccatcccaggttcattgagcattttagtatgagacttggtcttaaacactttacccctcgaagagactcattgtaaagacttagaatcctagcagagccctagaggaggagtattggctgctccctccctttgcaatacattgtaaacctcggttcacattggcagccactggggtcagtgtttctgctattgtatctcagtaagtacaaagaaacgcattttctccaaaggctgaagtgaactttgtagtgtaaacaccagtagttttagcattggccattggaaccacctaaaccaaaaatgaatccatttcaaaattcaaagaataggttcatctatttcatagtatgtaaataaaagtagttccagatttagtttctttaggatttagtctattccagacaatggtctactatgtttacaataaatatcataacagtcgcgtgcgataatggagacttaggaaagcttaaccccctcagcatgtttcttctgaaactgggaaaaccagcaaaatggttataaacttgtcactaacctttagtttgccagatgtatatcatgctacaaaggtaacttctgtaaatctatgagcatcagatcactatcattttcattaacaaaataattcatgggtctagtatttctggaacgtgagaaattaggaaagaaatacatttgttctaatatgcaagaagctgaatctcgagctgtatcgtgaagctgttaatttacttccccttggcacagccctgaccttgcctgatttaccgacaatgaatggaagccaggtgttcccatgcctatcgcatcttcgagagaaatgacaagtacttgctttacatgacacatcgaccgaacacttttgcttctcactgaaaattattcctgcagtgcatgaaaggagtttgtctgagtttgtgtacagagatctgaatttggaagtaaattccaccaagtggtgcagaaatatcacttgtaagagggggttgttagaggtaggtaaaatttggtttcagaaattgctgtaattaaataaatgggcaaaactgctcaaatggacaccacagatgactaatttaacaatgttcttatgttgtcattatattatttatataattatttacctcaggaaggtgtacagagtgggattgctgaattatagagtagctctatttttaatctttatagaactgtcatacagctttcaacacaggctgttgcaacttacgtttctaccagcaatgcacatgtacaagtgttccatttcctacacacacttgacagcacttgctatgtattgcctggtaatagccatcctagcaggtgtgagctgatatctcattgtggttttgatttgtgtggccctgatgattagtgatgttgaacatcttttcattcacctgttggctatttgtattgcctctttggaaaaatgcctattcacactgtctttaccatttttaagttgggtaatttgatatttgctaatgattttgtcagtttcttttatattttggatgctaactccttatccaaaatatggtttgcagatatgttctcccattgcagagattaccttttcattttattgtttccttttctgtgcaaaagtttttgcatgttgatgcagtcctacttgcttattttgcttttgttgccttaatttttgtgtcatatcaaaaatatcacggccaagatcaatgtcaaagagctgtttccctatgtcatcatctaggacttttacaagtccaggtcttccatttaagtcttcgatccatttagatttggttttgggggaatagtgtaggataagagtccaatttcgttcctctgcatgtatgtatctggttttcccaatgccatttattgaacagactatcctttcttcatgctgcatttttggcaccctcatcaaagactaattgaccatataagcatggctttatttctataatttgtaatatagtttgaaatcggagtctgaagcctccagctttgttctttttatcaatattgctttggctatttgatatttttgtgcattcacaaaatttctagaatggttttattctatttatgtaaaaaatgcctgtggattttagttggggttatactgaatcagacattttctggagtaatatggacatttaaagaatattagttattctaacccattaacatgagatatcttcccacttatttatctcctctttagtgaacagatctttcactccctcagctgtatttattcctatgtattttattctattggatggtattgggaatggtattcttttcttaattacatatttggatggttcctttttggtgtatagaaatacaactcatttatatatgtttattttgtatcctgcaagtttcttgaattctttaactctgatgggattttgctggagtcttgagttttttatatgtaaaatcatgtcatctgcaaacagatggcaagataatttaacgtcctctgatttgaaagccttttctttctttttattgcctaattgctctggctagtttctggtattatgttgaatagaagcagtgagagtgagcactcttgtcttgttcctgatcttagcggaaaatctttctctccatcgagtatgatttagctgtgagatttattatgtaaaggcacattccttctataacaaatctgctgagttctcatcatgaaaagatgtcgaattttatccaatgctctttctatgtctattgagatgcacaattgtttttgtcatttattctgttaatgtggcatatcatatttattgattggtgtatgttgaaccatctttgcatctgtgggaaaaaaacttgggaccccaatttactatgccaaaaggaaaaaagatactaagctgaaagctgagttatgcaagaaactgcatttcctttggtttttgttttctttttgttcctaatcagttaactacagatgaaaggttagagtaacaggcagtaactccacattctccttacctgacgtaaagcgatgatccttctactgagtgtgaaaggaatacataaatgactattcacctacctgcttctttgcttcttttcttcttgcaacctgtggattatcatactctccctctttcccctctagcctgctttcccctttaaatattaaagtcctcaaaattatctttaaagaaaagcacagaccacagactgtttctgtaattgtgttcttttttccaagcatgtcctttaccttggtgaaataaactttcaatctgattgagacctgtctcacatacttttggtttatacatcctaggaataatcccacttgattatggtgaagtatccttttaatgcactgcttaatttggcttgttagtattttgttagtttttaccaaaaattatgaaagctgtttttcaggaatattgacctataatattttgggagttagtgttcttatctggctttggtttaaaggtaatgttggcttcagtaaatgaatttggaagtgtttttgcccttcaatgttttgaaaaaatcagaggaggatatgtgttagttctttaagtgcttggatgaattcaccatgaagtcttctagtcctaggcttttcttgggagattttttttttttttttttttttttttttagacgaagtcttactctgttgcccaggctggagtgcagtggcatgacctcggctcactgcaacctccgcctcctgggttcaagtaatcatttcatgtgctgagtactcttatacctactttcttagcaattttcaagtatataattgttgaaactgtagtcagcatgatgtaccataaacctcctgaacttatttctcctgcttaaataaaattttgtatcctttgacccacatcttctcttttccttcctcactccaaactctggtaaccaccattttactctttgtttctatgtgtttgactattggacacttcacatataaatgaaattgtgcaatatttgtcctataccaggcttattttatttaaaatattgtcctctgggctcatccatatttttccaaattatagaattgtctttgacttttgacaaactgatcataatatgtctcaggtataatgttttggtttgttcttgcttgggttcctttgaactttatgaatctgcatgtctctatcactcacaaatttaggaaatgttgtcattttagctttgtttttttctccttctgtgaatgtcataatacacatatatatttgcttgatgttgtcttatagttcccagatgcttctacattttattttttttgttcctctaactgtatgatctaaattcaagttcattgcctcctttcactgtatgatgaaatatgttgtcaaagtactctgttgaccttttcacttccataattgtattcagaatattttacaagctttacactaaagttaacgagatttacacacctccattacagtactagagtgttccaaatttgactacaaatcttctcagcacaagaattctttccttttttgatgtcaatgtctttattatatttctcattttgtttatgcatttttttattagttttagatctctgttattttgaagctctttgatcctatttaatatgattttaaaattcttaggcaattcatagatttccatttccttggggttgcttaatgaagctttattactttggtggtatttattactttggtgtcacatttgcctgatttttttgtgactcaagtagctatgcattgatgtgtgcacatttgaagttgcaaacagctcttctggtctgcatagactggtttcagtaggtaaagacattctcctgtcatttctctaggctaataagaattacctccaggactgcagttgagcagggttagagccatgtcatgtggctactcctgagtctacagcagaatttttagttggcaagcttgttaccagaagtcgagttgagtataaatcctgtctggtctcttggtagagaagactgcctctagtaccttggtcaatagggctatcgctaggacactctgcttcagggttcacatttggttctgtagatggcatgcctgttaccacgtacagaaatgggtgtggattctattgagtcccttgaaggactcccattatattggtgggaaagtctctgggcaagaaggattgtccccagaccacagttgagaggacctggaactgagtctcagggctgtgtcatggaccacagctgagtctgaggtcttctgtcctgcatggatgggtgtacctcctgcatagtccctgtaaatataagatataagatatccccaagctgtggttgaatggaagctggagctggataagagggctgattcaggatctccagctgactgatgtcagcagtcttgtttacaggggcatcgatcaatgtgtcacccaggaggtcactgagtgggcaggactgcttttgaacaatggaaaagggtgccaagtaacagagctgcttcaagattggcagtcggacgtagttttgagagcctgcctctaggcacatgaacagggttgcctcctggcaggtctctgtgcaggaaggtctattcccagaccatggctgagggggactggagctgggtcatggactgcttcagggttcagagctagaactaaggttagcaggcctgtgacttgagggtactggtcaatgtgagtgcccctgggccccttggcagatggttcaggtggcaggaccaatgccaaacagggcactagctgagtccagagggatgttaattctgtgtctgtagccaggaccacagtcagtgagcctgccacctgggtgtggccctgccttctcaaaatagctctcttcagtgttgggattcaccagttttgacacttcctgtcaagatccagaagttcccaccaagggacttttgtgccagacaggctgctatattattgctgctttgaggggatacgattataggagctcctcttcaaccatcttgctaatgtttttaatctctttgtattaagaatatttctctagcacattattcaacttagattttactcaataagttaatttaaaacctgtgacaccagacagcaagttatctgctgtcaaaatgcaacagtgacactcacatataggatagacattcctattctgaaaaagagaaattggaagttaaatagaagtcttagagccaaagcaaacttgagcctggcagggcaagtttcgttagatttcaggacttgaggtcctctttggcttgatatcctgacctccagtccataaaggtggtggcccctcttcctttgttctgtgcatgtatcttgcatttctttatatctctgatggtgccttcaggatcatttacaaaatgtttgacatgttttatatatttatagtttaattcttaaaatgttatttttgtttttataaatattttctcagtttacatttaaaatgtaaaaaaagtagaactttaagcagggtttccaccataaatattaatgttgaaaaaatatatatcaatagcttttctgtcactgttaatgctttttaagtatttttaaatgaaaaatattctccaaaaaattaaattataaaaatctcagaatctcaattattgtggaagaattttattaaaattactttaaaatccagacccgacctctaagtatttggatatctctgtgagacctattgtgcttgtttataaaaatctgcaacattttaacaatatcaattcttcccaaatgtatttcattgtattctaatcaatacaattagttagaacttttgaacctagccaaatagatcaactgaaaggaaaaacaaacttaaaaacttgcttattttgaacatgaacatacatgaagacaagaattgtttcactagttgtttaaaattatcatgaggggacacccaataaaacaagatattttaaaggaattcagtgaaagaccaatggaaaagaagagataatgtggaaacctagcctcccctgcactggcttctggtataagatgttgaccctccttccttgtgtgatcccgttgtttcctccacacaccctggttctcaaaaccatgatttcaggactgccttctcttatgacctctggattcgtgtatacactagccttgcatcatcttcatgtagatgtgtactgggcaactggagtcccaaatttcagtttcagcgttccatgccaacctgcccagccccaatattcctgtgtgtataaacggcaatccaacttcacctcctccaccacaccccttgcccagacaccatatgtctcatcaggactagctcaaaccctttcctgcattctcgctcaagccttctcagtgataatcatatacctgttccaaatgtctttcctctctgtccgtcctccagtgatatctcagagtgggattcaccgagaagcaaggagagtcaaagctttggggcccttcactctctggagattctctgagtgctgtctgttgctgggagttgtatggtggggtggggtggggaggggaagccaggctacagtcagaacagactgtgagcatgcctggtaaacttcctgaagagttcttagaagacaggggccaaacattggctgagacttcctttctttttctaagtgcacatgcactctcttgagtgccgtgtatacttttgtcttccctttcttaaacacacctctgcctgtccctggtccttctcaggaccatcatgattttataggaccggttccttggttccacttctaaccccattttctgttttgccaactttctcacctcagtctggggccacagatcttcttgctgctgttcaaacgttgcaagttactttcagtctcacagcttttaactttctctgtttcctctgcttaaagcatctctgccccgttgtttacgagtgactccattgtttcatttacggatctgatgaaatttcaccttctaaataaagggctcctaactagcctgtgttaaatagattcgctaatcattcctatctcatctctctgcctttattttttatttactgtgattattaatacttgacatttcattacatatttattagtttattgcctgtatttaccactagtatataaatgctgtgtgggaagaatctttgtttcaaacatcataaacctagatagtgcctggaacaaacagttactaattatttttgaaattaatgaataaaagaaaataccattcaacattggaatttaattttaacttaaaagcaataatgttagcaattcactgcatatcacacccaaataaattatttttgtattataactcaaaggtaccaaaaaaacctctgaaactcattaaaagtgtaaaggtagatgctttacataatccccaaatgcataaagactttgtaagcacaaaacagttaacgaaattattaaagttaatatattaaacaaaatactttaaaaaattctgatgacacaaaatatcagaatgaaactgaaataaaaatattttagttgatactattcacaaagagttactattttttttcttttctttttgagacagagtttcactctttttgcccaggctggagtgcaatagcgtgatcttggctcactgcaacttctgcctcctaggtttgactgagtctcctgtctcagcctcccaagtagcttggattacaggcacgtgctaccacaccagctaattttgtagttttagtagagatggggtttcaccatgctggccaggctggtcccgaactcctgaccccaggtgatccacccacctcggcctctcaaagtgctgggattacaggtgtgagccaccgcatctggccagttattattttcataccaaaaacacatttatatttatgaagaaaacatttcaatagaagcagtagttacatggataaacatgaaaagttatataaacatattaattaaaaaagacaaataatgatacacctatgaaattgaccaagaaggaaaagcacacataattcagagctggtgcaagtgaagtttaattctgcagcaaaatttgaagaggcttttggaaaagtaattcaatgttgtatattaagaagtgtgaatcaccgtatatcaaatggtagattgtctcagggaaaaactgacattcagagtgtattttttgtataattagttttatttctgcataatttataatgttgaaatttttaatgtcactattcactcttaggagaagattgcaattgtgatataattactctgatagatattaactccagtagatactgtccagtcatatacgaacactacatattgcaaaccgaagagatgtaacacagaagattggttagaggtggcaaagggttacagggaaggctggagaagtgggcaggggagtgttgtcatccaaggaccaagagtcctcaccactggagccccatgtgcccctcactgctgagctgatgggaactctgcactccagggctgctgagagaaccctgccctggtgatgtgcagcaacccagatgcctgcatctccccaatacgactgaaactgcctctcaggtgctgaagtctgaggccccccatggtccctgttgcttatagctgctgacccacacccccatcagaaacggaaaaaagtagtttacttcttcctctcaccctgcagtgtccacccacaagggcctgcactctcagagccttacgaaaagtgaagtagcaaagaagtcaggacaaaccacgtgcaggctgcagcactgtgggtcagagactccagccctcaaacgtgcacctaaaaacaggacattgtctagacaaaggtggtcatgaaaagacctccatgatgtaggaaaatgatcaacatttttccagagcacgtctttagagaaaagttcagaggaatttggctgcaagatctaagatggcggtgcagtttcttctgtcttcttccctgttttattccaacagcctaatacagggtatacactcaatgaatatttgtagtttaaagggaagatataacatgtaaagtatcatttttgtctggtttattacattagagtcgattttaaaatttttattcaaccagttttactttagatttttctatgactttaatgacagtatttaaaacaaaaacaaagataaaaatcaaatgcaacactaaagcaataaagattgcaagtgagtgagagggaaacagactacaatcggtcctaatgaagagggagaaagatgaagatatgaagatgactccaattttagttttaatcaaggtactgatttgtggaggtatctttgacacatcagttgacctctgagtttcagattctatacctgtgaaatgttagaataaaaataacaatatcttacaacatttacttgaatattaaatgaagatcacacatatatatggaatatattttataatgtggaaaaggctaaggctgtatatgaactaactcctacatttcataaataagattttgatgatgatgagatttgagattactattactaatattggttaaaagtttgcatttcataacagaggtaaaaattgtaaaagctattagaagaaaaccagaattgttcaggagagatacctactgacttctttagctctcttaattgcattcttcttcaactcccagaggtgatgtatcaaccgaaagctttcaacccctcccctagtgcacacggtaaaaccaggcaggtcactttcttactcctgttggtgctcttaacctggccacacaccaccagcccatctaggtgaggttcaagacatcatctgatggtgagttcagccagacagacaggaggtactagcaggaagaaaagggtcatcactgctctcgacttgttctgcttctgaaacgttctattagttcttcacagcatttcctcattttttctttatcatctgtttttaatggagaaaagcaaatgttattctttcttataacttctatacaacacttatttactgtgacataatggtaaatagatttttaatttccaattatttatggacataataatatatattctatagttttagattttcatacaatgatgtatttattttcctgtcactgaagttttatagaggaaaagtgactgattttcttttgagaggggatgatttctgagggttacaaaacactagaaacaatgtctcaatcattttatgtttctttgatgaaacccacagacagtggcctaaatccaaagtgtagactgcagagggaggatggtgtccctgagaggaatcaggcagagttacgtgcgctggctctctctctcgggctgagacgtgcgttctatctcaggttaggtgtgtgatattaggcaggtaccctgagaacctgcattttttaatatgtaaagagagaaaataataggaagtaactcataggctcttgggaaagaagaaatgtaaagtattaattttagtattagtattagaacaattcctgggatgctgtatgcttcaaataaagatttgactccatttatacttacaataaatccccaagttaaacatgcattaagcaatttacatgaaagtcaaacaagcgggtacagaagaagaatgaacagggggccagttcactgtgtgtggatagtgttcccttatctgtcccgtgtcctggttgagctgttgatagtggcttaatgatagtggcttaatgatagtgatggccatttcctaaagagcagcagagatttcttaggaaaccccgcatctccctgccctcctgctccccctcaatttactgagcaaacaccttttaggtcttcacatgtgctggtcgctcctctggtccttgcttcactttggccacaaataatggacgaggtcagcaggtgtgttttgcagtttattggaatgtttttaaattgtacacagatctcagccaccatttgccagtaggggtagtgtttgatacacattatctatctatctatctatcatcatcatctattcatatatatacatatgtacataaaatgtgtctcagatttgttggatatttatattaaagcaccgaagcatcccagaatgttggaagttttggtgagttgaatgtcttaaatactttttgtaattactacaagaatacaaaatatatttgaaacttgtaaattcattccaaaatgtccctgcatcataatcacagctaaagtcttcccagaaagaggagttattatgtccttattcttggcaagggctctcaaaatttaacatttaatatgtcagaagttgaaaagttggaaagttttaatttctttcagagaaaatgtggaaacagctattatggattatttcagaacggccagatatattttgtgtctattgcccttatttattttgtaactatttaaaaattcaacttcaaatcacatttacataatagttgttccctgaatagactgactgtgacctccttaagtgcactcaagttcaatttttctttgattcatcttctgcatataacacagaggctgtgagtatcatgatagagaaggaaacagtgagttgaagtcagaggcgattcatcgtcagtataacacaggctgtgagtgtcacggtagagggagaaacagtgagttgaagtcagatgcctcagtgttgtttgattttcctccctgcttctcagtttgtatgaaagattgattgtggcaagtaataaagcacatgaggtttgcaaaaacaactaaagccttgtctgataaacagcagtgaccctccaaattctagttcttcctcgctgagatttaatgagctttaaaatgagaggagctttaaggagatgaggttggaggaccacatactaggcaggaaggacataggagtctccaaaaagctctgcataaccagggttaaaataagaaatgttatagttatatattcacctgtgtatgtttacataaatatattatatatatttatataaaaccagagtatttacacataaacacacaaatataaaatccaaattgtttttttttaaagtgggtcatatgctttattttgcagaacttctgccatttttattttgaaagtcagcttcttaaatgtatgaataggtactgaatctggagaatggaagtaatatatcttatataataatagtagcaacaatctcttaggttgtgcagaatagttagcttaaagagttaacatctacactaagagtatatgtgtttattcatcggaaactgtactattctaagcactttcattacatttcctcattttaccctcaccacacctgagctcaaacatgatttttatcctttttgatgtagattggagaaaggaatggcagacagagaaaaaggtggacccatagctggagtctactgtgtgtgggctcctcacttcacgtctctcgatgtctaaagggtcagctgtgtgtgaggacccttccctgctcatgagaatgtgaggctcgctccacgcaatcacagagcctcacagcatggcctgatcctatgggaggaggaggttcaaacatctggcataattttttttccaagttacgctttagttacttgctaaatctttcttatatcatatatacctctgagtattttgaagatgcctattgtttcttaaaccagcgatgttgattcaattcagctgtctatgacaaaaactctacaataaggagtttgctttatctttctttcaatgagtcactgtttgtgttagcagaggagggaggttctgcaaattttcagtacttgttgataaatggcattatcatcaggaaagtttatgaatttgaaccgtgacaaccttactatcagttaccaattcttctggcctatagttgtgaattcttagtttgttttgtgaatttgttatatgtcatttatatactcaaatccccagacccacgggactcaggttagcacaatgagcatacacaaatgtgagtactcacgaaacactcattacaaagggacgcgttacactgactccaaaactctccttggtggcctaggtgaaacctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcagatacttaggattttatccctgttattccttagactctcatacaatgatgcctcatctcatattcatctcattttgaggaattctttcactgtgtggaaactctattttatagtctttgtccatccaaaattcttttacaattgtgttatactaatgtaacatttttggaagttgataactgttctctaattttgtgaaaaaatattcttaacctcaggaaatacttaatatttagagacaaaaaggtcatgaggtgttcaaatgatgagagggaaagagggagggagatagagaggggcaatgaaacaaactgagttcaatgttgctgccacacatgagtatgggtaaagggtatataggtattaattgtactattgttttttaatgatttttgtgaagttgaaatcatttacaaataattaaataccaggcttttctccctttttgaaaatattctcctttctgcttggtggcagtgtgacatcttagaaatcatgctcatttcattatatctaatcattaccaagaaaatccagtcatcgccccttctttattgagggctacatttttctgcatggtccaattctgatggcgtctagtggatttatctctccgaaataattactgccatgtggtgtattgaggatgtaggaccacataagtgactgcagaaaaaatatgacacctgagtggaaggagttttaaggaaggttacctgcccagggtgattcctgagctgagatttcaaacatgtaacttgttatacaaacaagcagagggatggcatcaacattcaatccttcatttatttaacaagcattttgtactattttataattaaaaatagttaaataagattaaattttgaatagcacatggcttttaccaaggagtttgaaaaatacatgtagttgtttatgcaaacaaatgtaagaaaataaataagctgttttgatactcgtgtgaagggtgcagctcataaggacacactaattctatctgtgacatctgagttcaaacaaggagctgagaggagactccggggctcagtgctgaatagtgacgaaaagttaccctcagatgagtgtgtgatgttggagccaggggaacttgctgagacacgctgcaagggaaaaggcacagcatgagcaaagacagggctgagcaagcgagagagatcaatgcccagtagatctttcttatttcatgttaggcttatttcttgcccttgtgtggcccagggttttacaaacaatagtgaaatgatcagatttgtattttagaaatgttatttgtgtggtgatcaattggagatgtgcaagaccaaaaacatagagaccaggtacatgagaatggtaatctaaatgatgttgatctaagtggagtcgaccatgcctttacccgagaataggctgataggagggcatttgaggtggggcctgctgaacctgttacctaaaagcatacatgtggtagctgcatgctataacttcctaattggctatgtacaacttgcgaataatcaggtgttttcaacagtacacattcttcttttctctcaccacactcaattattttatgactataatataaagattctgtagtgctttggaaaaatatgagagaactagtttttaatatttttcctgaactcagacaatataaaatgcatactctaactttgtatgaattaaagagcatttgtcaactctcaatttgctggattataattatagacacatttgatggttatctttaaaacatccttgtgaaaggaaatgtagcaaaatttcatgaaaaatgatttttgtagagctttattgtgctaaaaattgttagctgcctaaaataacctgttataatatgttggtaagtctcgtggtaactacaaagcaaaaacctgtagtagacatacaaaaatttttaaaaaacaaggaatcaatgcataccactagaaaaaacatcatttaaccgtaaaagaagatagtaagaatggaagaaaagaacaaagtctctagaaaacaactggaaaactaacaaaattgtagcattaagtccctatgtatcaaaaattatcttaaatgtaaatgtattaaattatccaatcaaaagatatctggtggcagaatgtataaaaaatgccaactacaacaggttactttaacctgcaaggacatatgcagacgaagtgaagtggttgaaaaggatatcccatgcaagtcgtaaccagaaaagagcaggagtagctatgcttatatcagataaaatagactgaagtccagaactgtagaaagagacaaagaagatcatatataatgattaaaaagtcaattcaacaaaaagtatataataattgtgactatgtatgaaacattaacctaaatacataaagtattaatagatctaaggggatagatagcaataaaataatactaagaaacttcaacacccctctttcagccatggaaagactatccagacaggaggtaaacaatgaaataacagcttcaagttgcactctagggcaatggacctaaaaagcatatgcaaaacattttattcagtagctgcagaatacacattatactcgattgcacatgaaacattttctaggttagatcacatgtttgaccacaaaaaagtcttaaagataagaagttcaaaataatatcaatcatcttttctgatcacagcagtttataaacgaatgcaagaattctcagaaagtttacaaataaatggtgattaaataatatgctcctaaacaatagatgggtcaatgaaaaaattaaaagggaaaataaaaggttgtttgagacaaataaaaatggaaaactcaacataccaaaacctacaggacacagcaaaagcagttcaaagaggaagtttatagtttatagcaatgaatggctacatcaataaagaagaaagacttcaaataaggaaaggtaatattgtaccttaattaactagaaaaacaagaataagctaaactcaaaattagtagatacattaatattgattagaggagaaataaaaaaatgataaaaacaatgcaaaacatcagatgagttgttttgtgaaaaaacaaaataaactagactaagaaggttcaaatcagaaatttacaaaggatatattacaactgaggccacagaaatacaaaagattatgaaagtataatgaataattgcatgtcaaaaattagataagctggaagacatgaattgactgatacataaatcctacgatagtaaatcttagcaaaccaataatgaataatgcagtgaagtagtaataaaagtctcccaccagaaaaaaaaaaaaaaaagcccaggacaatatggactcattgcaaaattctatcaaaaatttaaagaactaataccaattattctcaaacacttccaaaaaattgaagaagtgggaatactttcaaattcattatacaaggccagaattatcctaataccaaagccagagaaggacatgggaatgaaaaaggaactacaggtcaatatcatttgggaacatggatgtaaaattcctcaaaaaatgctagaaaactgaatttaaaagcacatttcaaaaagcattcatcatgataaaatgggattcatcccagggatgcaaggatgcttcaacagatgccaattaataaacatcacatagcacagtaacagaatgaatgatacaattttatgattatttaggtggagagaagcatttgacaaaattccaaaactctcaacaaattaggtatacaaggaatgtatctcaccataacaaaggccatatatgataagcctacagctgacataatacttaatgatgaaatgttgaaagctttttctctaagatccagcaaaagaccagaacggtcactcttgccacttttatgtaacatagcactgaaagtcccagctaaagcaattagggaagaaaaataaatagaaatgtaaataggaaaggaagaagtgacatgtttctgtttgttaataaagtaatattacatataaaaaaacataaagccttcaacaaaaactattccctaacaaattcaggaaagtttcaggaaatcaacagacagaaattggagtttctatactctaacagcaaactgtatctttaaaaagttaagaaagactcatagagaggagttatagcaacaagatagatgaatagaagatcctccagcatcattcatccacacccacaaaaatagaactggaaactattcaaaaacaataacatcctgaattcccatgaattcaggagagaaaaaagagaagctgtgtctggtcttagagcaattaggtaaaagaaggaaacaaaggcctccaaattggaaagaaggaactgaaattttccctgtttacagatgacatggtcatatattaaaaaaatcctaatgacaccagcaaaaactgtgagaactgataaatgaattcagtaaatttgcaagatacaaaatcaacatacaaaattagcatttatatatgccaacagtgagcaatctgaaagagaaataaggcaatcccatttacaaaaactaaagtaaatacaaaataactaggaataaatttagccaaagtaaaagatctcttcaagaaaaactatacaactctaatgaaagaaattgaagagatcacaaataaatggaaagattccccatgttcgtggattagaagaattgatatcattaaaatgtccatctaccaaaagagagctacagaattaaggcaatcactatccgaatacaaaagatattcttcagagatagaaaaaaacaatcctaaagttcatatggaagcaaaaaagactccaaatagccaatgcaattctgagcaaaatgaatgaatatgtaggcatcatactacccgatatactacaagctattaaacatcaaaagagaatggtactggcataaaagcagacacacaaacagaagagaacccctgagagtccagatataaattcactcatttatagtcaactgatgtttgaccaagttgaaaagaacatacaccaagaaaagcactacttcctcaataaatggtgatgcaaaaaatgcatatccaaatacagaatgaaactagacacttatttcactattttaaactcaaattggattaaagactttaatatcagatcttaaactgtaaaacttctggtagaaaacacaggcagaatgcatcatcactacattgatctgggcaagaatttttaaagtagaacctcaaaatcacagggaaaaattaaaaaattaaaaaatgagattacatcatactgaaaggttcttcacaataacgaaaacaattcacagagtgaatagataacatacgagtgggagaaaagatttgccaacaatgcatttgacaaggggttcatatccagaatatataaagaactcaagtaactgagtaccaaaattatcccacaaataatttgatttaaaaaatgggcaaaagacatcaaaaaacatatttcaaaagaagacatacaaatggctagcacgtatatgacaaagtgctcaacatcactaatcatcagggaaaggcaaactgcaatgtcttggatggacatggtatctttcactttgaaactggagtcctgcaggccattttgaatattgttcatgtttcctaacacacccaagttggcagaagaccccctatttaggtctaatacctgctgtttatgctcaaataggcccaggcaatacaagttttggctatgactccagttatgtatatttctggaagaaacaatagatgggtataaaataaagtatggtagagtgaaatcatcatacctgtacaggaatgtaaatttggaggtcatttttcttatcaggacacatcacacggggaatgtgtttctttagtaaatgttgtgtactcctttagatatacttataacaaaccaacgatgcatggcatcaggataagtttagaaataattactaaacgagattccatagggtagagacaagaaattagattttgcctatgttcaagtgggagaatacccatttcaaatacccaagattatagaagaaggaatgaaaaagtttcaactttaagctgctgagggaagcttgaaaagaatttagtctgacatttgatattctttataaccatgtgactaattactcagatggtacttaggaattaagaaaagtcattaacctacaaaaagcccgaagtataagaaaacacagttaaaggtgtgttttttaattgtctttgctggattcggttagttcaatagccttgtcttcaagctctgaacttgtttcttctacttgtttgattctatttctgagattttccagtgtattttgcatttttctagtgtgttcttgatttccagcagttgtgattgttttttatttatgctatctgtttctccggagatttttccattcatgtcctgtaacacatttttaaatttaagttggtattcacctttctctggtactttgttgagtagcttaataattgaccttcttaattctttttctggcaattcagaaatttctcctttgtttgaatccattgctggtgagctagtgtgatctttgggggtgtcagaaaaccttgttttgtcatattttcagaatggttttcctggatttttctcatttgggtagactatgtgagagggaagttctggggctaaagggctgctgttgagattcttttgtcccatggggtgctcccttgatgtggtgctctaccccttcttctagggatgggggttcctgagaaacaaagtgcagagattgttatttctcttccacatctaaccacccagcgaagctactgtgctctggtactggctggtaccggagagtgtctgcaaagagtcttgtggtatgatctgtcttcaggtctctcagccatggataccagcacatgctgtggtggagggagcaggggagtgaagtggactctgtgagggtccttggctgtatttttgataagtttgctggttggtctccagccagcagttgattctttcaagagttgcatcagctgcagtagtgtagggaagatacgagcttgccttagggttacctggataagtatccagatttctcaggcaatgggccgggcctcagagctcccatgagattatgtcctttgtctttggctcccagggtgggtagagaaaggccaagaggtgggggcagtgttaggcgtgtctgagctgagactctccttgggcggggcttgctgtgtggctgctgtgtgggattggggtgtggtcctcagactgatggagttatgtttccacggggattatgagtgcctctgctgggtcatgcaggtcaccagagaagggggggaacgggcagttacatgcttcactcagctcccaggcagcccaaaaggccagtctcactcccaccttgtgcccccagtagcactgagttttttccaggcagctggtgagcagggctgagaacttgccccaggctacaagcccctcatgaagaaagcaagcagggcttttaggtttcatgcctctctgcctgcctcagcttctgagcttgtatctgcactcccagtttgccccctcccccaggttctgtccaggaagcttcacgttagtcaagattattacaaaattcatctgaaagcttgcttctccttgtagtctttccccaattccactggcagccctcccaaaggacccctgcaagacaaagtccgaaatggtttcccacagggctcttcttgttgtttcctctactcgaatattttgcttggctctctaaattcctcttagctccgcgtaagattaaatccttttcccaccatgtggaccgtcaggttccccagtgaggatctgtgcttgggggtggagcatcccccttttacactttcacacattttggcactcagtctttggcacggagcctacagtggccgccacctccttcaaagggtctttggattctcttggctttcctggtatgtcctatggtagttcttggagcaaaagttcacagcgtgaatctccacatgctgctctgtccatccaagtgggagctgcaagttagtcctgcctcctatctgccatcttcctcttctggagtccacgaaaaggattataaacaaactattttgttgggagtaataatgtggtcctggcctagtgtgaagtgaagctcactccaggccatttctctcaagctgtgttaatttgtacccttcagcagtttatgagaggttcatttccataggcccccacatctacaactaggggatttcatatatctaatctgagcagggacattggttctacatggagacagtgcagagatgagctgtgcttgaggcctcacctgtaggtggtagggtctagaccgggagacaggcattggccaacagaaataaaggacacaaagtgatgtccttctccactcacttcagcttttcttcaacactatttcagatgcttccttcctggcttagctcttcattcaaggtgagatattatgggaacaggattgtgggggcaggtggccccaggtatggagactaaggggaggtgtacatggcaagagagaagccagaatatggggatgagaaaggaacaagctgtctgtggtagtcatccatgattgagatgatgtgtggaccctgagtcagactacctggttcaaatgcaggctctctactttttacccatttgatcttggcctgtggctctctacttcttatccatttcatcttggacttgtggcctctcatacctcatcttccttacagtcctccatatgaaatccccctaaagtaggaacaaagctttggccaactgctcctcccatctttccgtggtctttacttaggaactgtgtgtttaatatacgtgacacagggtttctcccacatccctgagcagaaacaagctgtgtctgtattttgcactgtactcacccccatgctaaaccccctcatctacatcctgagaaacaaggatgtggtggggctcttcagaaagttctgggaacacatcaagtctctaaacagaacacataaatatcaatgtggaaaacaacggtagagggccaagatgcaaagacttcaggagcatctcattttccagcatgaggaatgttgctccatcgtatgagaaaaccatttggttcaatttaatttgaaatattaatttgctcataaaaagcttaagggctgggtgcgggggctcatgcctgtaatcccagcactttgagaggcctaggctggcagatcatttaaggtcaggagtttgaaaccagcctggccaacatcgtgaagccctttctctactaaaaatagaaaacttagccaggcacggtggtaggtacctgcaaccccagctacttgggaggctgatgtgggagaatcacttgagcccgggaggcggaggttgcagtgagcagagatctcaccactgcactgcagcctgggacacagagcaagactctgtctcaaaaataaataaataaataaataatgaaaagcttaagaactttttatctagtttctaaccattgtttcaaaatggctgaactcaactgtgtttctccttgaagctagatgataagcatagacaaagttccagtcttctctctttttacctgctttagccatttctcagtatcctttgaagctcaactctgtccaggtattgctaatctccattgttgtaagcatcagcttcctaggaaagacaaaagtgtgatttctcaggggcaataataacacaatagattttcttttctcttgattgctctggaaatcccaacatgttggctctattctcttatcctgtctcgggtggaaacttctggtgattctcagataagcaataactcagctgatatataatacaagaagattttctcttctataataaatacagcaagccttgagtaatagtacgtaatctgtgggtgagcaaggaacaataggcttctctcttgactttgtaagttcctcccattctcactagctctagatgcttactcttcctcgagtcagtgcaggtggaactcaggggatagagtggaagtaggggctagaaaagccctacctaccttccaccaatacagagaagcttcccttcaatttttggtggtttgattataatatgtcttaggggtagttttgtttggattgaatctgattggttactttttacctcactgtacctggttatttatatctttttccaggtttgaaaagttttctattatttcttcatataagctttctactcctttatcatttcaactcccttatctccaatgactcaaaaatttgctgttttgttgctgtccagtaaatctcatgtttcctttattatttttcattcttttctcttctctattttcatataacctgtatttgagttcacagattcattggcttgatccattctgctgttgatggtctcaactgcagtttacattttgttcattatattttgcagctttagaatttgtttgatttttaagttattccaatatttgctaagtttatcattgtggtcatattatttttatcgtttgtttgaatagtttctgtgtattttcttgaagtttgctgagcttccctaagactgttatttcaaatgctttgtcaggtagtttatgcatctccatttgtttgcttggtgatgtatgcttccttgatttctcttgcgtctgcagtcatgcatctaatataataggtacttattccagtctttgcagacttgttttatcctgaaacattcttcaatagtaagcctgtctagagattctgagcaggttgtctggtgtggtccctaagctctagtttgctgtggtgggggcagccctaggtggtgccctaagcctgggactgccacgactggtgcagtgcagtgctgtaatcccatggccactggaactggtgtgggtcccagatgatatcctgtggccactggggctggtgcagcactgatgcaagtctgaagcccatgttcactgaggcctgcctgccagtggatactttccagagcttaaggccactctgggtgggtggcagtgatgatgactgcaaattaattctgctttgcatggtttctgcctagtgttggtgtagatctggaggctcggtctttgtgtactggcctggagtcagtggttgtgggggctgcctggttttcagtttttctgtagtgggcctagtgttgggcaccaagaccaagtcccacacttacttccctttttattccccaagtgtttggtatctctccctgcactgtgctgtctgaggttggggataagaaatgcaggtaatcagaactctccttcctgccctcttcaatgtttattattttatcacaagaagaaaatagtataactaggtacaatgatctctcacatggctttactagcttttgtgaaggtatgtagtgtaagaatagttattaaaattgatgtttctatggggatacaattgttaaagaattccgttctgccagctttcccactctcctctcttttcacttttttgattgagacctttgaagcacaaaaattttgaagttagatgaggtccaattatttattttcttattgctcgttctttcggtatcatgctaaaaaaaatgctaaacttaaggtcttgaatatttaacttcatcttttctcatatttttataattttacttcttatgtttaggtccctgatcaatttgagtttaagtatgatttgtaatgccacttcattcttttgtttgtggatatcttcttgtctgagcacaatttgttaaagtgagtattcttttcccattgaatggacgtggcacacttgtcagatgattattgaccatagacacatgcgtgtatttctcattagattctcaattgtcttctatttatttatgcatatatccttattctgttatcaggcttttaaaattagtgtatctttttggcaaattttgtactcaggaagtgtaaatcttccaactttgtttttctattcaaggttgttttggattttgcagtcgctcgtaatttcatatgatttttagtgttttctactcttgcaaaaaaaaaaaaaaggcatggaatttttataggcattgtattgaacctgtggatatattttggttgtattatcttaaccacaagtctcccaatccattaacatgcgatgttgtttcatcagtttatgttttatttgctattagcagtgctttgtaattttcagtgtgttgtttaacactactttaagtttcttcttgagtaagtgttggtagtttctgtgtttccaggatttggttttcatctcactgaaggtatctagttagtattcaattatttgtaatattctcttataattgcttgtgtttctgaaaggctagttgttatgtacccatgttatattcatatttatgtattcatgatgtaagacttctctctttctctctttggtaagtttacctaaagttttctatattttgttgatcttttgaaagctcgaaatagtcaaattgttttttctattctgcattttattaatctctattccaatacttttttttccttctgtttgctttgtattgagtctgctcttctttttctagttccttaaggtgtaaaaatatattattgtttttagatgtttcttctttttttgagtataggcaatctagctaaaattttccttctaagagttgctttagctgcatcctatatgttttgttatgttttaagtcatctgaatatattttctaacttcatttccaatttcttttttgacccaccggtgcttcacagtgtggtgtttaatccccacatatgtgtaacttttgtagttctccctctatttcagatttccagttttatttcattgattggaaaagatactttgaattaaatcttttaaaatttagtcttatttgtttttggcaatttatcctggagaatgtgttattagtacttgagaagcatctatactctgctatttcagtattctccacatatatattaggtcatttggtttatagtgctgttctagtcacttactactatattaacattctgtctaagtgcactatgcattattgaaaatggacatttaagtattgaactataagtacagaactgtttatttcttcctttaattctgtccaccttggcttcatatattttgggtctctgttacattcattcatgtttacaatttttatatctaaagatctatattacattctccaaggaagatacacaaatgatcccaaacagtatacgattttttttttacttataaaaatttttgtcataaactcactttgtctcacattaacatagccactctggctatctttcggttaccaactgcacgaagtatctgtttatcttcatgtatagtatatgataaaatgttatattcacagataaaacaatttaaagtataaaattatgattcaatatgctttttaatttccttgaacactttcttttcttctaaatctattttctttattcctttatagtttattattttcatatgcttaataaattcaggaatgacaaagttgaaatacaaccaactacatagaagtacaaaaaaccctaagggactattatgaacacctctctgcagacaaactagaaaacctagaagaaatatataaatccctcgaaacaaggaatttatctatttctccacccaagattatttaacctcctgacattaagccaggaagaaattgaaatcctgaacagaccaataatgggttctgaaattaagtcagtgattaaaaaaaacctaccaaccaaaacaagccctggaccagacggattaacaaccaactcctaccagacatataaataagagttggtacaaaatcttctgaaattattttaaaaattgagaagggaatactctctaagtcattctgtgaagccagcatcattctgataccaaaattaggcacaaatacgacaaaaaaaagtaaagttcgggccaacattcctgaggaatatagacacacaatcctccacgaaataccagcaaaccaaatccagcagcacatcaaaaagtgaattcaccacgatcaagtaggctttatttctgggatgcaaggttggttcaacaagtgcaaatcagtaaatgtgattcaccacataaacataattaaatacaaaaatcacatgatcatctcaatagaagcaaaatgatttttcataacattcagcatcctttcttcttaaaaaccctcaatatactgggcaccaaatgaacttatctcaaaaaaataagagccatctatgacacacccacagccaccatcatactaaacaagtaaaatctggaagcattcctcttgagaactggaacaatttgaacaattcagttttcaatttctcatcaaaaattgtgttgacatgattgattgaagtattttatccccctttctcccaaataccaggccacagacagcatgaaatattttaaataaacattaaaataaataagtccagattggtcattaaatcgagtattttttttttattgtataaactcaagatgtacaacatgttttgatgtagatatctatagtgaaataattaccacatgctagcaaattaacacatccatcactgtctgcagtttacttttttgtgataaaaacacatataatctagttattctcttagcaaatttgtaatgtataataaaatagaactatagtccttctgttgtacattagatctctaaatatctttatgttacataactgtaattttgtcttcttttacctacattatcccaatttgtctacttccctgactctggcaactgcccttcaactccctatttatcttactcaatttccatttattttacacataaatgagctcatgctgcatttttctttctgtgcctgacttgtttcacttggcatattgtactccatactttaaaatttattaagcttaaagaattaaacaagtaagctctagttgcctaagaagttaatgtacccagaaatataaatttctcaacaatcatggaaaatgtgttacaactatatcttctttcaagtaggtcttgtaaatattttctgtattaatactgactatgctctcgtttggttgtcattctattctgagtttttaaccctcttgtttaacccaatctctcctcctcaaaaatgaataaatgcattgactcaagaaacatttatttttgagcgtctgttttggaataggtgctatattttaggcattggaaagacactagtgataaaaatggtaaaatgctttatctcctggatcttacattctatggtagagaagagataataatcgcaaaaaaactatcaggaatgataaacattataaagaagagtaaaatagggtgtgtaggagataattactgttttatattcactgctcagagatgtcttctctgataatcaagagagcagagaagagagacctaaatcagttgaagaaatgggtcacaacgtatcggaaaagagaccaccaggcagagagaatagtaatctttttttctttattcagtgtattaaatgcattgtgtttattgatataccccattagtttaatcatattccctcacactttgttattacctttattttaattgccatttttaaatttttgtgatgaacaaataaaattgtatatatttatcatgtacaatgtgatattttaaaatatgtatattgtgtggaatgggtaaattgaggtaattaacatatgcatcacctcacatacttataattctttgcagtaagaagacaaaatcaactctttgcctttatttcaaaattatttcattgtgtggtatttaatattttctatttaacaaaatgtgtatattatgtacaaatacctatgcataaaacatattttataagactaaaatatccttaatttccctctctttacacagtatctactagtttcctagcataaggaagaacagaaaatatttcagaagatatgtctattctcctttccttcatcattcaattgtagccaatatgtttacactagtgcttatcactatttctttacacttgcttttatattttctccatcatctttattattttacaatcactcacaagccacggagcagccattcagcttcgtccccatcactccctttaaattctctcctgactcagggtgattcccatttcacatctttctgttggccgattgtcgtctctttttagtgggtcatcagttctctgaaccgtcatatttctgttttaaaatgttttctcatttataaaactgctttattaaggatttggggttgtagagtatttgaagtttatatcagtatttagctccgatttaaggcaataattttggggtagatttattttttttctatagtatttttggaaagacgttgcattttctaatttcatttttaagaatttgatttgcctttccagttgttaccaggtggattgcatagggcttgcaggcattggggaatattcttgtttctcaagccctacagcttcattgtatgcattcctgctgtcttctccatgttcatttctaccaccttcctattcgtggttatgcctgggatggtgacccccttagtttaggcaagattgtcctgttatctccaccacttctttcccaggtatactccctgcatctatctcttcaataatcctcagattgctacctggctccgtgttcatcaggcttgggtatagcagtttacacttgtgagaggaccctctccttcttggggaataatatttcctggtattttttatcattaccaccaccagtgaccttgactgggtctcttctctgccggacttcctgcttccaatatggagtttctgtaccaattctgatgagtgtccgtgactttcttccccttccttacatgtaatttatagttgatggattgcctttgtctcctgatttcagtgaaggaatcatttgtgcttttttcattttttttgtcttggatgtttattatatcattggagaattaaagtaggataaaaagattggaagactatctaaaagtttgtatcagcaactaggactcccttatgtatgtttgaacagttttgttctgtttgcttttgtgagaaatgagatgaattgatgtgcaaagtgttattagttagggtgcctcaatataggcccaggaaacattggaacaccaaaatggatggagcagacatgagcagaacacaaaaaagaaataaacagcaatatgataatagtaggggattataataccccactctcaacactcataaacaacaaatggacccaaaaataaagacaatttaaaaatatcctgagacaaacaaaaatggacaaataacataccaaatcatggggtacagcaaaagtagttctgatagctactgagacagagagagaaatgatcccaaataagcaacctaacttggcactctgggaattagaaaagaagaaaaaagccaaaagttagaagaaagaagaaagttataaaggttagagcagaattaaacagataagaaagacaaaagaaaagatcagtaacacgaggagttggttctgtaaaaacgtgaggaaaattggcaaacctttaggtagacaaaccaagaaaactaagagagatgactcaaataaaactataagtaaagcaggagaaattagtcaatactaccaaaatacaaagggtcataagagattatcatgaccaattatgtcaataaattgagtaacgtagaagaaatggataaattcttagacatgtatgtcctgaagaaagaataaacctgaacaaattaataactagtacagagattaaatcaccaataataataataataaacttaaaagttcaggacttgatgcttttactggtgattgctaccaaatatctaaagacagattaatgctattctcaaacttttccaaacaattaaaaagggtgcactttccaacacattttttcatgcattaccctaacaccaatgtcagacaaggacggtataagaaaattacaggccaatttattttatgatcatggatgtaaagattctcaacactagcaaactgaattcaatatgttcaaaagatcatttagttgaatgttttctttcttctgaaattcttcattttgcttccaaatgtcatttttccttatattttattttttcattaatcaaatttaattttaaaatttccaactaaaaaaatctgtgggtttaataaacatatttttaattaacatttaaaaaaagcacaagtttgtaaattgtatattttctgtccattagattttggtttgagtattgggccaattgcacggtaagctttttaatttttttccagaagtaatcccaggaccttaaatctccactgaaactctcgaagtttaattggtcagctgggattgtagtccctggggtgttgaaagcataaataagccataccttaagtctggaccatttatccctgtagggagtccctcttctcctctgttctctttcagaactacttattactttaggttcagtgtatgtagcatatggtgactctatgggtttcagttttctgaaccccaaatatgcaaaaatatagaaaaagcagaccaggcatcccaccttctgtgtgccactaagggagcatctcttcctctttctcccctaataagttgtatattattttctcagtattttaattttttgctatttatattatctgagatttatcattggaatcatacaaatattaaaccaggaaagatcacccaggaagaaattgagatcacccacaatatcaggtattctaaaacatgttatatgaaaattgtaataattaaaacatgaatcacaaatcttgcaggtagaaatgtcaacatattaatttttttgaggaagagcaacttggatgaatatatggatgtaaacttgctgatcaactacagccaaaaattacattgtaattgtaacgtgtccctaaacttgacccattaccaatcctgataagtctgtgcttaggattatgtagattttcaaaggattgaaatgtagttgccttttccaaatcttgactagcttgtctgacaaggtaggatcatgtcaagtagattggactgaggtgatccctttattttaaagagcagtctttggcaaacactgatactagaaactgatatgattttgctcttgttgaagaattttacttattataaatgttttttaaaaacaagggaaggaaacataatcttaaaaccactcatttgtgtccatccacattatactgtagagaagactgacttttttttccaggtgattattgtagcaaaacattttaagttttattgagatcgtttgtcatgtctaaatttgttcatcataatatatcctgagcttagttcagtgcctggctcatgataaattttatttatttagtgtggtgagagcacttaacaggaaatttaccctcttacactttttcagtgcacgattcagtactgtgaactccaggcacggtgctgcacagccaatctctaggacttcatcttgtgtcactgaaaccttatacccattgcacagtagatcaagagaagaaatacttgatacacggcacaagacctatagaacacgcagggaaaacttcttctggcatcagaaaacctgttcattgctgagttcattcattatattcacctccttacaccacaatgctaacccatgaatctaactggctgtgacaaaactgtctttcataaacctacagactttaagatttatggaaagagaaagacctgtggcatcctagaattctaacatccactcttggatcatcatgaccacttagcagagctttgcattgaattccagataaagaatatcaaactcaaggatatagcagctcttgaataatgggaaagataaatgaagtgtttggcaagtagaaagataatcatgaagttcagtcattaaagtctcgccctgaacaaatgccatggacttgacatcataaaaaacataaaataggtataagtcaaaaatgtttattttgggaaattatatttaaatcaaaatcaaaaatatactcatctgaaagacaacagaaagttctgtcaccaagggaaataaaactctaattaccaaaacaaaatgtaaacaaaataaaacttacataaatatatacattcatgcattcaaaagaagttgcatagaattttatttagccatatctcagtattttggaattttgcaaacaccaagagtcgcaataataatacataatcttcgtctctcactctgttattttttcctcaagcttgggaaagataatgtgtgagtggatagagtgattctggggatcgggatgagacaattctgcttaaggcaacttctcttaggatggcaggaggtagcaagagaagaaagggcagaataaccattacagtttacaccatatttatagctataatgccttaatataatatgaagtaattactttcaattactttttaataacagagatatatacaatatatattctttaaaatggttatctaaaagtttaagaaattaaaaaaccttaatcttagaaattatctagaaatttaaatttctgaattataggtaaatgtgttatgattttcttttttcaaataagccttacaaatattttcaatattgatactgtttcattttaaatgtgccactaacatgatgctgtcatttcattgtcattctagcagtaaggattctgagtccttagcactctgtttgacccagcctctccttccaggaaatgactaaatatactcattcagagcatatttatttttgagcatctactttggggctaccactgtgttaggctttcagcacacagcagtgataaaaatgagcaaaatgtctcatcttattaatatgacactatattgtggaaaagagaaacaattgtaaaaaatatgttcaagattgttaattttatgaagaaaaataagacagcataagggacagatcagtcatttttattcattggtcattgaaatcttttctgataatcgaatagcacagaagagacctaaaagaactgaaataatgggttctagtgtatctggggaaaacgactcaaggtaaagggaaccatcatctttttcagatggcactcagagccataagaggttcagatagatccacccagcagtgagtgcagtgggtttttctaggcagaaaacacagaagaaacatcaagaaatcacatgattggcttgccatgtccaagtccttttctaattttgtttttctttttaaagcatattttttgcctgctaccatgacttgtaatttttgatgatgttgttgaaagctgatgtattcatttgctatgcgtaccatagcattctggtagtttgatgacaacctttggcattccttggcttgaagtagcattacttcaatctattcctttatcttcaaaagataatattcctgggtgcatgtccaactttttttaaataaggacaccagtttcaaaggtaaagcccagacactggttaaggtagtgaggacagattttaattagtaacatattttggggtatttgtgggtttttcacctaaaatgtaatcttacacaggctgtagattatatctctgtttccaggaagccccgtgtgttgctttgtgtgtgcatcagtctctcgagaaccccctgtgaatcaggaggcatacgttccagtgactatagggagtcgaggggctaaagaggtaagtgaaacatctggtaggggtaaaaggatgggtatatatcaaaagtcaggggtgtttaatggaaaagaggtgcatatcaaagtgtcaggggagttcaatggaaaaagttaagatggtaaaagaaagaaggaaaaaagaaggaaatgggaagggagcagtcctataagagccactttaggcagatcttaagattttcaaataaaccattgcagttccgaattatccacagtaaagtcattttgcctaaaatagaagcagacatggttagtgtcatagtatatatagagagtaggaacccaaaaggggtttaactgtggagttcctgtgggaagagtaagttcaaatagaatgaagaggtctcacaagaagccagagtgaacattccagcacaggagttaggaagtgaattcccactgaaaacagggagccaggaagataaacagccagcccaggagatgtctttcaaaagcagcctggaattataacccagccttagagactacagccagaaacataggaagaaaatatgtcctcgccatgcctcagtgcaaatttctacacagtgttaggccagaagttgaactcgccaccaaatacccaaaaaagtaagtcaactgaagatcagacaaaggtttctacgcatgcagaaaggattgactgttttgtccaagggccagataagggttccaatctggatttgagttccagtgccagataactgtcaagacaaacaaaatggaaaactggttaaagaggtaagaacgtgctttaactagtcatatactattgaaacaggcaagagttcagcatgaacttaactttgatgtatccaggttgaggaaaatgttaaagggagtttgaggaaagagaaatgggagttagtgggggctcaggagggtcagggatgtgagaaattacaaatcgtgagaaggggggagttggttcctgtgaaacccatttgctttgttaactgatacttgctgatgttgggcttctaccctcccacagaggtcaggagacaccaggcctatcttcaagtcttggctgggacaagcatgctatagattgtctgtgtacttacataagttatatgttgaaatcttaaaccccaatgtgatgatattgggagaggaagtctttgggggttgattagatcatgagtgatgaactcatgaatggccttagtgacctcataaaagagactccagagagctttcttgcctcttctgccatgtgagggcacagcaagaagaccatgctctataaatcagaaaatgggtccttacagaccaaactggctggcacctttattgtggactttccaatctgtggaaatgtgagaaataagtgttgtgtaaggccatggtatttttgttataggaaccatgaagacaggcaggtttcagttttctcagacagttcactttaagggagactgggtcgttcgttctagagatgtagacttgaactgttaccaactatgttcctgtctttttcaagtttttatagaccaaagttaaggctgaattgagaaggctcagaagaccctggctagagtttcgtcaagtttaaaatgatcgtcaactctgtatacatcaaaattgagttcagtgcgtgctggactgttttctctgtttcaatagtatatgactcattaaaatatgttgttactactttttcttcaatcatattggattagggacactttctactagagtatgttctcatcttcaattaactaattacatctgcaatggtcctatttccaaataagggtacattctgagatagttgggggtatgacttcaatatatgagtctgtggggatacaattcttaccataatttacatgatgtgttaggtaaagataaacaggcgtttagtgtgaagtttatgtttatgtgttaggctatgtttatcgctagttttacctctgatgtcagaggccataatttgctctagtgttcttatttttgtgtcctctgttatctttggcttttctacagattcattgttaaacaggatttgaggcttgtcatccttccatgtgcatcctctgttatcatacatgagatattttaatgtgtttgtcagtgtggaagggagagaaatcattctatagtcctacaaattggtctgaatctatttgccagcatgtgttcttggactgcaaccttcaaagagcttcttaacatcccctgcccacccccacataggtgtgacacaggttagaaggacctggagttgggtattttccttctagcatattggttagcctgtggtaaaaccccagtaatacggcagcctctgttaaatagtttattttttttaattatactttaagttctagggtacatgtacacaacgtgcaggtttgttacatatgtatacatgtgccatgttggtgtgctacacccattaactcgtcatttacattaggtatatgtcctaatgctatccctccctcctccccccaccccacaacaggccctggtgtgtgatgtcccccttcctgtgtccaggtgttcttattgttcaattcccacctataagtgagaacatgcgatgtttggttttttgttttgcaatagtttgctgagaatgatggtttccagcttcatccatctccctacaaaggacaagaactcatcattttttaaggctgcagagtattccatggtgtatatgtgccacattttcttttgtgtgtgtgtttttttttttgttttgtttaagtttttcttttattattatactttaagttttagggtacatgtgcacattgtgcagattagttacatacgtatacatgtgccatgctggtgcgctgcacccactaactcgtcatctagcattaggtatatctcccaatgctatccctccccccaccccacaacagtccccagagtgtgatgttccccttcctgtgtccatgtgatctcattgttcaattcccacctatgagtgagattatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgggtcttatagcagcatgatttatagtcctttgggtatatacccagtaatgggatggctgagtcaaatggtatttctagttctagatccctgaggaatcgccacactgacttccacaatggttgaactagtttacagtcccaccaacagtgtaaaaatgtttctatttctccacatcctctccagcacctgttgtttcctgactttttaatgtttgccattctaactggtgtgagatggtatctcattgtggttttgatttgcatttctctgatggccggtgatgatgagcatttttcatgtgttttttggctgcataaatatcttcttttgagaagtgtctgttcatatccttcacccactttttgatggggttgtttttttcttgtaaatttgtttgagttcattgtagattctggatattagccctttgtcagatgagtaggttgcgaaaatttcctcccattttgtaggttgcctgttcagtctgatggtagtttcttttgctgtgcagaagctctttagtttaattagatcccatttgtcaattttggcttttgctgccattgcttttggtgttttagacatgaagtccttgcccatgcctatgtcctgaatggtactgcctaggttttcttctagggcttttatggttttaggtctaacgtttaagtctttaatccatcttgaattgatttttgtataaggtgtaaggaagggatccagtttcagctttctacatattgctagccaattttcccagcaccatttattaaatagggaatcctttccccattgcttttctcaggtttgtcaaagatcagatagttgtagatatgcggcgttatttctgagggctctgttctgttccattgatctatatttctgttttggtaccagtaccatgctgttttggttactgtagccttgtagtatagtttgaattcaggtagtgtgatgcctcgaggtttgttcttttggcttaggattgacttggtgatgtgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatagaatgttcttccatttgtttgtatcctcttttatttccttgagcagtggtttgtagttctccttgaagatgtccttcacatcccttgtaagttggattcctaggtattttattctctttgaagcaattgtgaatgggagttcactcatgatttggctctctgtctattgttggtgtataagaatgcttatgatttttgtacactgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatcctgtcttgtgccagttttcaaagggaatgcttccagtttatgcccattcagtatgatattggctgtggctttgtcatagatagctcttatgattttgaaatacatcccatcaatacctaatttattgagagtttttagcatgaagggttgttgaattttgtcaaaggccttttctgcatctattgagataatcatgtggtttttgtctttggctctgtttatatgctggattacattgattgatttgcttatattgaaccagccttgcatcccagggatgaagcccactcgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccttctttttctattgattggaatagtttcagaaggaatggtaccagttcctccttgtacctctggcagaattcggctgtgaatccgtctggtcctggactctttttggttggtaagctattgattattgccacaatttcaaatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggataggtggtgatatcccctttatcattttttattgcttctatttgattcttctctctttttttattagtcttgctagcggtctattttgttgatcctttcaaaaaaccagctcctggattcattaattttttgatgggttttttgtgtgtctatttccttcagttctgctctgattttagttatttcttgccttctgctagcttttgaatgtgtttgctcttgcttttctacttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatatacccagtagtcattcaggagcaggttgttcagtttccatgtagttgagtggttttgagtgagattcttaatccttagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgggatggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgagtgctcctctgttgggtgcatatatatttaggatagttggctcttcttgttgaattgatccctttaccattatgtaatggccttctttgtctcttttgatctttgttggtttaaagtctgttttatcagactaggattgcaacccctgcctttttttgttttccatttgcttggtatattttcctccatccttttattttgagcctatgtgtgtctctgcacgtgagatgggtttcctgaatacagcacactgatgggtcttgactgtttatccaatttgccagtctgtgtcttttaattggaacatttagtccatttacatttaaagttaatattgttatgtgtgaatctgatcctgtcattatgatgtcagctggttattttgctcgttagttgatgcagtttcttcctagtctcaatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcatttaggaagcttagtttggctggatatgaaattctgggttgaaaattcttttctttagaatgttgaatattggcccccactctcttctggcttgtagggtttctgccaagagatccgctgttagtctgatgggcttccctttgagggtaacctgacctttctctctggctgcccttaacattttttccttcatttcaactttggtgaatctgacaattatgtttcttggagttgctcttctcgaggagtatctttgtggcattctctgtatttcctgaacctgaattttggcctgccttgctagattggggaagttctcctggataatatcctgcagagtgttttccaacttggttccattctcaccatcactttcaggtacaccaatcagatgtagatttggtcttttcacatagtcccatatttcttggaggctttgctctttttattcttttttctctaaacttcccttctcacttcatttgattcatttcatcttccatcactgatagcctttctccagttgattgcattgcctcctgaggcttctgcattcttcatgtagttctcaagccttggttttcagctccatcagctcctttaagcatttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtgaggaactgcgttcctttggaagaggagaggcgctctgctttttagagtttccagtttttctgttctgttttttcccatctttgtggttttatctacttttggtcttcgatgatggtgatgtacagaagggtttttggttttctcccattctatagcttgcctgttcactatgatgatagtttcctttgctgcacagaagctctttaattagatcccatttgtcaactttggcttttgttgccattgcttttggtgttttagtcatgaagtctttacccacgtctatgtcctgaatggtattgcctaggttttcttctagggtttttattgttttaggtctaacatttaagtctttaatctatcttgagttaattttttataagatgtaaggaagaagtccagtttcagttttctgcatatggctagccagttttcccagcaccatttattaaacagggaattttttttcccattgcttgtttttgtcagttttgtcaaagatcagatggttgtagatgtgcggtgttatttccgaggcctctgttctgttccattggtctatatatctgttttggtaccactaccatgctgttttggttactgtagccttgtagtatagttcgaagtcaggtagtgtgatgcctccagctttgtcctttttgcttaggattgtcttggctatatggcctttttttggttccatatgaaatttaaagtagttttttctaattctgtgaagaaggtcaagctagcttgatggggatagcattgaatctataacttactttgggcagtgtggcatatatatccaaaggattataaatcattctataaagtcacatggacacatgtttattgtggcactattcacaacagcaaagacttggaatcaacctaaatgcccatcaatgatagactggataaagaaagtgtggcacatatacaccatggaatactatgcagccatagaaaaggatgcattcatgtcctttgcagggacatggatgaaggtggaaaccatcattttcagcaaactaacacaagaacagaaaagcaaacatcgcatgttctcattcataaatgggagttgaacaataagaacacatggacacagggaggggaacatcacacaccagggcctgttggtgggttggggggctaggaaggagggatagcattaggagaaatacctaacatagatgacaatttgatggctgcaggaaaccaccatggcatgtgtatacttatgtaacgtgcacgttctgcacatgtaccctagaacttatagtttaaaaaaaagtttgctttggctttcgatgtaattctacttagacaactcttatacatatagagtaacatgtacacacatttcattttacaaattctcccttttattttgacttggcatttgacaatatcactttgatagtagcttgtgaatattagtcaagatttgtatagaggtcgggcacagtgactcatgcctgtaaccccagcactttgggaggctgagtcaggtggatcacttgaggtcagttgttcaagagcaccctagccaacatggtgaaacaccatttgtactaaaattacaaaaattaggccaggcacagtggctcacgcctataatcccagcactttgggaggctgaggtagttaggtcacctgaggtcaggagttccagaccagcctggccaacatggtgaaacccccatctctactaaaaaaaaatatatatatatataaaaatatatatatatacacacaaaaattagcgggcatggggcctgtgcctgtaatcccagctacttgggaggctaaggcaggagaattgcttgaacgtgggaggtggtttgcagtgagcagagattgtgccactgcactccaccctgggagacagagtgagattccatctaaaaaaaaaaaaaaaaaaaaaaaaatacaacaattagctgggagtggtggcacacgcctgtagtctcagctactcttgaggctgaggcaagagaattacttgaacccaggaagcagaggttgaagggaacagagatcacggcactgtactctagtccaggcgacagaacgactccatctcaaaaaatatatatatttgtatacatataacaaaatatttgcatcaaaaggacattgggtcagttgctttacctgcataaatacatcatttgaacatataaatatatcggtgtaaaaatgggcaaagtacaagaataagcaaagagtgaataaatacaaatatcaaataaaacaaatgttaatacaatacttttgttgtttgagtaaaactttattcaataaaaatagaaggaagtggcatttcccgcccatggatttatgttgaggaaagttctataggtcttcacaacatgttttaggtgatatataaggaagataattatactgtaaacgactgtggattaccattcttgacctcattactttctatccccaaatattaatcacttagtatttgaagctgaagagtcctgaagctgcaggaaaaatggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactaggaaacacctggaattctaaacaagggaaacacctcaaggcagagtgagggttcatcctccccagacattcctcttgtcaatcccaaagccacagggactaggaagcattggaattctaaagaagggaaacacctcaaggcagcgtgaggattcatcctccccagacattcctcttgtcaatcccaaagccacagggactaggaagcattggaattctaaagaagagaaacacaccaaagcagcatgagggttcatcctcccagacattcctcttgtcaatccaagaccctgtgttctatctggaaaaaaatgtttgtccttcatccacctgccatcaaggttcatgtatccattatttccttctaatgtgccagcccatctgatagacttctactaatgcttcaaaactcagctgaaatgtcacctgcactcactagctgtcctgaaacaccatccttctcatccttgtgcagaattaactgtttcataatatgtttccatagcacttgatccacactaccatttctacatttcacatttgagatatatgtatacatatatctctaactaggcaaagcaatgtatataacagactgaaaaaatacatgaccattttcccagaatatgtcacttttaactggagaatggaaccatcccactctattggcttatttacaacacgagaaacacaaatattaagagttgtgatgctttggttccacagaattgtgggatgcaaataatgactaatattttattaaaggaatcaaataagcaaacttgaattaaggagattgattaaaagttgagtaaaattgccatatactaaaatgtgttttaacatttatacaaaattcataaaataagttattgtttttggccttaaactctggaaaacagttacttatgtaattttatacttcaaaaatttgaaatatgaatcccacacactgtctcacgttaacgatcatagttatatgtttggtttccaaaacagcaaaaaaaatgaaatatttagaagcattttaataaatgtattcttatatttgaccaaacttttactttctgatttaattctgtctctatctctctgtgtatctttgtgtgtctcagcctctttcttgctttcttttcccaaaacgattgaacttcatcaattcgtcaacctcaagtattttaagagaactgtgcaattatagaaaaaagtgatttaatctgtggttgtaattttacttcatattctcattatgatacacatgaaaaaagcatgaaaacatcaatgcaaatgaagagtaaaatgcaggcagaatctggggtggaagtggaattttcaagtgatttagacttttcttttttggacagggtcttgctctgttgcccaggctggagtgcagtggctcaatcatggctcactgcagccttgacctcctgggtttaagtgatccctctgcctcagccttccaacattcagatttataataattcatcctggtgtgagaatattgtagcctgtctacgaatgttaaggataacgtttggacctgcctctcctaccaaagcctggactgaaggcaaaatggctgcgcacacaagaacaaaaaggcatcaggagaattcactaatgactcaggctgcctcttcacaaataccctgtccagctggcacctcttcaatatacttttagcaaacaaaatgatgaatatccaatttaacaaaaacgagggaaaagaagcctggttaaatttgtcttctaggatattcttatgtgattttcctcctccagtaatggagaggagagttgggaactgagcagaacatgctgaggagcacatgtttttatttacaatatgcaagtagagaagtagttctacaggaagcgtcacatgtacaaatgcattattcctgataacccgagcaacacagcataggaaagaatgtacctgtgtcagagtctcaatcaatttacatggaatatggccccagggcaaaagatgtggcatttaaaggaaagaaatagctccaggtgaaaagacaaccatgtgtaaagcaatgatatgaacacaatatgtagaaaaacctacatatgaattgtgaagcaaccattttcaaagacaaactcacatccatttaaggtaatatggaatacaaatcccactgaaaataaaatcaaattattactgtatacaataaattcaaacataattcagaaaaaaatagaatatctgcttattgctgaaattagcatctttagctgtaagttatttgcacccaaaaggaaaccagaaaataatagatataacataggcaaagcaacctaaaaaaactacttaactgcagatgaaaatgggaacacatttgaaaataaaatcctgttactactttcttgaatttagagctttcctatgatatggatatgtttatactgcttttataatcatcatacatgtataatttcatactatttttatttataatgtgagcatttttctgattaatctaaaaaatatccaccatttattaaaaatcttccctataattgaataacatgagtagtttctcttttttaaatacctacattgagcatacttttgtttgtgaatgcttataattatgtacttataatgtattttataaatacaattagtaaatctaaaacaggtacacatcagtcaatttgcacacattactagcttgatctgcagaacacgttttcaaaggatgcgccaagaaaaaaactatcacttagttaaatgaccattcagtattgcaattatttaaaaactatacaatgagaatgctgtaataagtatatggttccaccactccaaacaccatgaattttttttaaaagatatttttaagaaaaaataaaatgattttacataacaaatattaatgaattcatgaaaaacaaaaaccatataggaccacagctcagagaagaaaaatgggaggcacttactatttaaaccctaacccaaatggtcagtaaaaagacaagtaccagctactacaaaaaaacaccaaaatataaagaccaatgatactgtgaagaaactgcattacctaatgtgcaaaataaccagctagcatcacgatgacaagatcaaattcacacataaaaatattaatcttaggcagggcacagtggctcacacttgtaatcatagcactttgggaggctgagtcaggtggatcatgaggtcaggagttcaagctcagcctggccagcatggtgaaaccccatgtctcctaaaaaaaatacaaaaaattagccaggcacagtggtgcatgcctataatcccagttactcaggaggctgaggcaggagaattgcttgaacctaggaggcagaggttgcagtgagccaagatcgtgccactgtactccagcctgggcaacagagcaagactccatctcaaaaaaaaaagaaaaaaatgtatatgttatcactttggtctcatttgagtatgaatgatcagacagggaaaataaaagtaccaagaaaaataaacaagggtcttataataaaagcaacacagaatggccaaagctatcctgagcaaaaagaggaaaaaagctggagccatcacattactagacttcaaaatatactaccaagttatagttaccaaaacagcctggtattggcataaaaacagacacatgggccaatagaacagaatggagaacctagaaatagattcatgtatttacagccaactgatttttgacaaaggtgccaagaacatacactggggaaaggagagtttcttcaataaatgtcctggaacagtaatcagcagctggggctggtaccatagggatacttaaagttgaatttatcaattgctggaagctcatgtgaactaacttgacaaataaaaaaaatgttgagccccagtcttaggaaatcctccctatactcatgatttttaccttcaggagtctcaacagcttctcactgtgcaaagtagagagaaattcccttttgctttggcagagagaggagaaaataaacatttgaaatatgcccagagctctctgttcaccataacctgatctcagtagtaactatttaatgattgccattctaactggtgtgagatgatatctcattgtggttttgatttgcatttctctgatggccagtgataatgagcattttttcatgtggctgtgggctgcataaatatcttttgagaagtgtctgttcatatctttcgcccactttttgatgggttttttttttcttgtaaatttgtttgagttctttgtagattctggatattatccctttgtcagatgagtagactgcaaaaattttctcccattctctaggttgcctgtacactctgatggtagtttcttttgctgtgcagaagctctttagtttaattagatcccatttgtcaattttggcttttgttgccattgcttttggtgttttagacatgaagtccttatccatgcctatgtcctgaatggaattgcctaggttttcttctagggtttttatggttttaggtctaacatttacgtctttaatccatcttgaattaatttttgtataaggtgtaaggaagggatccagtttcagctttctacatatggctagtcagttttcccagcaccatttgttaaatagggaatcctttccctatttcttgttttgtcaggtttgtcaaagatcagatagttgaagatgtgtggtattatttcggagggttctgttctgttccattggtctatctctctgttttggtaccagtgccatgctattttggttactgtagccttgtagtatagtttaaagttaggtagcatgatgcctccagctttgttcttttggcttaggattgacttggcgatgcaggctcttttttggttccatatgaactttagttttttccaattctgtgaagaaagtcattggtagcttgatggggatggcattgaatctataaattaccttgggcagtatggccattttcatggtatttcttcttcctatccatgagcatggaatgttcttccatttgtttgtatcctcttttatttcattgagcaaacaggtgctggagaggatgtggagaaataggaacacttttacactgttggtgggactgtaaactggttcaaccattgtggaaaacagtgtggtgattcctcaggtatctagaactagaaataccatttgacccagccatcccattactgggtatatacccaaaggattataaatcatgctgctataaagacacatgcacatgtatgtttattgcagcagtattcacaatagcaaagacctggaaccaacccaaatgtccaacaatgataaagtggattaagaaaatgtggcgaagatggccgaataggaacagctccggtctacagctcccagcgtgagcgacgcagaagacaggtgatttctgcttttccatctgaggtaccgggttcgtctcactagggagtgccagacagtgggtgcaggtcagtgggtgcgcgcaccatgtgcaagccaaagcagggcgaggcactgcctcactcgggaagcgcaaggggtcagggagttccctttcctagtcaaagaaaggggtgacggagggcacgtggaaaattgggtcactcccacccaaatactgcacttttccgacgtgcttaaaaaacagcgcaccacgagattatatcccgcacctggctcggagggtcgtactcccacggagtcggagtctcgctgattgctagcacagcagtctgagatcaaactgcaaggcggcagcaaggctgggggaggggcacccgccattgcccaggcttgcttaggtaaacaaagcagccaggaagctcgaactgggtggagcccaccacagctcaaggaggcctgcctgcctctgtaggctccacctctgagggcagggcacagacaaagacagcagtaacctctgcagacttaaatgtccctgtctgacagctttgaagagagcactggttctcccagcacgcagctggagatctgagaacgggcagactgcctcctcaagtgggtccctgacccctgacccctgagcagcctaactgggaggcaccccccagcaggggcagactgacacctcacacggcagggtactccaacagacctgcagctgagggtcctgtctgttagaaggaaaactgacaaacagaaaggacatccacaccaaaaacccttctgtacatcaccatcatcgaagaccaaaagtagataaaaccacaaagatgggaaaaaacagaacagaaaaactggaaactctaaaaagcagagcgcctctcctcttccaaaggaacgcagttcctcaccagcaacggaacaaagctggatggagaatgactttgacgagctgagagaagaaggcttcagacgatcaaattactctgagctacgggaggacattcaaactaaaggcaaagaagttgaaaactttgaaaaaaatttagaagaatgtataactagaataaccaatacagagaaatgcttaaaggagctgatggagctgaaaaccaaggcttgagaactacatgaagaatgcagaagcctcaggaggcaatgcaatcaactggagaaaggctatcagtgatggaagatgaaatgaatcaaatgaagtgagaagggaagtttagagaaaaaagaataaaaagagcaaagcctccaagaaatatgggactatgtgaaaagaccaaatctacatctgattggtgtacctgaaagtgatggtgagaatggaaccaagttggaaaacactctgcaggatattatccaggagaacttccccaatctagcaaggcaggccaaaattcaggttcaggaaatacagagaatgccacaaagatactcctcgagaagagcaactccaagaaacataattgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattctaaagaaaagaattttcaacccagaatttcatatccagccaaactaagcttcctaaatgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccattgagactaggaagaaactgcatcaactaacgagcaaaataaccagctgacatcataatgacaggatcagattcacacataacaatattaactttaaatgtaaatggactaaatgttccaattaaaagacacagactggcaaattggataaacagtcaagacccatcagtgtgctgtattcaggaaacccatctcacgtgcagagacacacataggctcaaaataaaaggatggaggaaaatataccaagcaaatggaaaacaaaaaaaggcaggggttgcaatcctagtctgataaaacagactttaaaccaacaaagatcaaaagagacaaagaaggccattacataatggtaaagggatcaattcaacaagaagagccaactatcctaaatatatatgcacccaacagaggagcactcagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcagacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactaaggattaagaatctcactcaaaaccactcaactacatggaaactgaacaacctgctcctgaatgactactgggtatataacaaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaagtagaaaagcaagagcaaacacattcaaaagctagcagaaggcaagaaataactaaaatcagagcagaactgaaggaaatagacacacaaaaaacccatcaaaaaattaatgaatccaggagctggttttttgaaaggatcaacaaaatagaccgctagcaagactaataaaaaaagagagaagaatcaaatagaagcaataaaaaatgataaaggggatatcaccacctatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatttgaaattgtggcaataatcaatagcttaccaaccaaaaagagtccaggaccagacggattcacagccgaattctgccagaggtacaaggaggaactggtaccattccttctgaaactattccaatcaatagaaaaagaaggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcgagtgggcttcatccctgggatgcaaggctggttcaatataagcaaatcaatcaatgtaatccagcatataaacagagccaaagacaaaaaccacatgattatctcaatagatgcagaaaaggcctttgacaaaattcaacaacccttcatgctaaaaactctcaataaattaggtattgatgggatgtatttcaaaatcataagagctatctatgacaaagccacagccaatatcatactgaatgggcataaactggaagcattccctttgaaaactggcacaagacaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaatcagtgtacaaaaatcataagcattcttatacaccaacaatagacagagagccaaatcatgagtgaactcccattcacaattgcttcaaagagaataaaatacctaggaatccaacttacaagggatgtgaaggacatcttcaaggagaactacaaaccactgctcaaggaaataaaagaggatacaaacaaatggaagaacattctatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccacatcaccaagtcaatcctaagccaaaagaacaaacctcgaggcatcacactacctgaattcaaactatactacaaggctacagtaaccaaaacagcatggtactggtaccaaaacagaaatatagatcaatggaacagaacagagccctcagaaataacgccgcatatctacaactatctgatctttgacaaacctgagaaaagcaatggggaaaggattccctatttaataaatggtgctgggaaaattggctagcaatatgtagaaagctgaaactggatcccttccttacaccttatacaaaaatcaattcaagatggattaaagacttaaacgttagacctaaaaccataaaagccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcaaaagaaactaccatcagactgaacaggcaacctacaaaatgggaggaaattttcgcaacctactcatctgacaaagggctaatatccagaatctacaatgaactcaaacaaatttacaagaaaaaaacaaccccatcaaaaagtgggtgaaggatatgaacagacacttctcaaaagaagatatttatgcagccaaaaaacacatgaaaaatgctcatcatcaccggccatcagagaaatgcaaatcaaaaccacaatgagataccatctcacaccagttagaatggcaaacattaaaaagtcaggaaacaacaggtgctggagaggatgtggagaaatagaaacatttttacactgttggtgggactgtaaactagttcaaccattgtggaagtcagtgtggcgattcctcagggatctagaactagaaataccatttgactcagccatcccattactgggtatatacccaaaggactataaatcatgctgctataagacccatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcataatctcactcataggtgggaattgaacaatgagatcacatggacacaggaaggggaacatcacactctggggactgttgtggggtggggggagggatagcattgggagatatacctaatgctagatgacgagttagtgggtgcagcgcaccagcatggcacatgtatacgtatgtaactaatctgcacaatgtgcacatgtaccctaaaacttaaagtataataataaaagaaaaacttaaacaaaacaaaaaaaaaaacacacacacaaaagaaaatgtggcacatatacaccatggaatactctgcagccttaaaaaatgatgagttcttgtcctttgtagggagatggatgaagctggaaaccatcattctcagcaaactattgcaaaacaaaaaaccaaacatcgcatgttctcacttataggtgggaattgaacaataagaacacctggacacaggaagggggacatcacacaccagggcctgttgtggggtggggggaggagggagggatagcattaggacatatacctaatgtaaatgacgagttaatgggtgtagcacaccaacatggcacatgtatacatatgtaacaaacctgcacgttgtgtacatgtaccctagaacttaaagtataattaaaaaaaataaactatttaacagaggctgccgtattactggggttttaccacaggctaaccaatatgctagaaggaaaatacccaactccaggtccttctaacctgtgtcacacctatgtgggggtgggcaggggatgttaagaagctctttgaaggttgcagtccaagaacacatgctggcaaatagattcagaccaatttgtaggactatagaatgatttctctcccttccacactgacaaacacattaaaatatctcatgtatgataacagaggatgcacatggaaggatgacaagcctcaaatcctgtttaacaatgaatctgtagaaaagccaaagataacagaggacacaaaaataagaacactagagcaaattatggcctctgacatcagaggtaaaactagcgataaacatagcctaacacataaacataaacttcacactaaacgcctgtttatctttacctaacacatcatgtaaattatggtaagaattgtatccccacagactcatatattgaagtcatacccccaactatctcagaatgtacccttatttggaaataggaccattgcagatgtaattagttaattgaagatgagaacatactctagtagaaagtgtccctaatccaatatgattgaagaaaaagtagtaacaacatattttaatgagtcatatactattgaaacagagaaaacagtccagcacgcactgaactcaattttgatgtatacagagttgacgatcattttaaacttgacgaaactctagccagggtcttctgagccttctcaattcagccttaactttggtctataaaaacttgaaaaagacaggaacatagttggtaacagttcaagtctacatctctagaacgaacgacccagtctcccttaaagtgaactgtctgagaaaactgaaacctgcctgtcttcatggttcctataacaaaaataccatggccttacacaacacttatttctcacatttccacagattggaaagtccacaataaaggtgccagccagtttggtctgtaaggacccattttctgatttatagagcatggtcttcttgctgtgccctcacatggcagaagaggcaagaaagctctctggagtctcttttatgaggtcactaaggccattcatgagttcatcactcatgatctaatcaacccccaaagacttcctctcccaatatcatcacattggggtttaagatttcaacatataacttatgtaagtacacagacaatctatagcatgcttgtcccagccaagacttgaagataggcctggtgtctcctgacctctgtgggagggtagaagcccaacatcagcaagtatcagttaacaaagcaaatgggtttcacaggaaccaactccccccttctcacgatttgtaatttctcacatccctgaccctcctgagcccccactaactcccatttctctttcctcaaactccctttaacattttcctcaacctggatacatcaaagttaagttcatgctgaactcttgcctgtttcaatagtatatgactagttaaagcacgttcttacctctttaaccagttttccattttgtttgtcttgacagttatctggcactggaactcaaatccagattggaacccttatctggcccttggacaaaacagtcaatcctttctgcatgcgtagaaacctttgtctgatcttcagttgacttacttttttgggtatttggtggcgagttcaacttctggcctaacactgtgtagaaatttgcactgaggcatggcgaggacatattttcttcctatgtttctggctgtagtctctaaggctgggttataattccaggctgcttttgaaagacatctcctgggctggctgtttatcttcctggctccctgttttcagtgggaattcacttcctaactcctgtgctggaatgttcactctggcttcttgtgagacctcttcattctatttgaacttactcttcccacaggaactccacagttaaaccccttttgggttcctactctctatatatactatgacactaaccatgtctgcttctattttaggcaaaatgactttactgtggataattcggaactgcaatggtttatttgaaaatcttaagatctgcctaaagtggctcttataggactgctcccttcccatttccttcttttttccttctttcttttaccatcttaactttttccattgaactcccctgacactttgatatgcacctcttttccattaaacacccctgacttttgatatatacccatccttttacccctaccagatgtttcacttacctctttagcccctcgactccctatagtcactggaacgtatgcctcctgattcacagggggttctcgagagactgatgcacacacaaagcaacacacggggcttcctggaaacagagatataatctacagcctgtgtaagattacattttaggtgaaaaacccacaaataccccaaaatatgttactaattaaaatctgtcctcactaccttaaccagtgtctgggctttacctttgaaactggtgtccttatttaaaaaaagttggacatgcacccaggaatattatcttttgaagataaaggaatagattgaagtaatgctacttcaagccaaggaatgccaaaggttgtcatcaaactaccagaatgctatggtacgcatagcaaatgaatacatcagctttcaacaacatcatcaaaaattacaagtcatggtagcaggcaaaaaatatgctttaaaaagaaaaacaaaattagaaaaggacttggacatggcaagccaatcatgtgatttcttgatgtttcttctgtgttttctgcctagaaaaacccactgcactcactgctgggtggatctatctgaacctcttatggctctgagtgccatctgaaaaagatgatggttccctttaccttgagtcgttttccccagatacactagaacccattatttcagttcttttaggtctcttctgtgctattcgattatcagaaaagatttcaatgaccaatgaataaaaatgactgatctgtcccttatgctgtcttatttttcttcataaaattaacaatcttgaacatattttttacaattgtttctcttttccacaatatagtgtcatattaataagatgagacattttgctcatttttatcactgctgtgtgctgaaagcctaacacagtggtagccccaaagtagatgctcaaaaataaatatgctctgaatgagtatatttagtcatttcctggaaggagaggctgggtcaaacagagtgctaaggactcagaatccttactgctagaatgacaatgaaatgacagcatcatgttagtggcacatttaaaatgaaacaatatcaatattgaaaatatttgtaaggcttatttgaaaaaagaaaatcataacacatttacctataattcagaaatttaaatttctagataatttctaagattaaggttttttaatttcttaaacttttagataaccattttaaagaatatatattgtatatatctctgttattaaaaagtaattgaaagtaattacttcatattatattaaggcattatagctataaatatggtgtaaactgtaatggttattctgccctttcttctcttgctacctcctgccatcctaagagaagttgccttaagcagaattgtctcatcccgatccccagaatcactctatccactcacacattatctttcccaagcttgaggaaaaaataacagagtgagagacgaagattatgtattattattgcgactcttggtgtttgcaaaattccaaaatactgagatatggctaaataaaattctatgcaacttcttttgaatgcatgaatgtatatatttatgtaagttttattttgtttacattttgttttggtaattagagttttatttcccttggtgacagaactttctgttgtctttcagatgagtatatttttgattttgatttaaatataatttcccaaaataaacatttttgacttatacctattttatgttttttatgatgtcaagtccatggcatttgttcagggcgagactttaatgactgaacttcatgattatctttctacttgccaaacacttcatttatctttcccattattcaagagctgctatatccttgagtttgatattctttatctggaattcaatgcaaagctctgctaagtggtcatgatgatccaagagtggatgttagaattctaggatgccacaggtctttctctttccataaatcttaaagtctgtaggtttatgaaagacagttttgtcacagccagttagattcatgggttagcattgtggtgtaaggaggtgaatataatgaatgaactcagcaatgaacaggttttctgatgccagaagaagttttccctgcgtgttctataggtcttgtgccgtgtatcaagtatttcttctcttgatctactgtgcaatgggtataaggtttcagtgacacaagatgaagtcctagagattggctgtgcagcaccgtgcctggagttcacagtactgaatcgtgcactgaaaaagtgtaagagggtaaatttcctgttaagtgctctcaccacactaaataaataaaatttatcatgagccaggcactgaactaagctcaggatatattatgatgaacaaatttagacatgacaaacgatctcaataaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgcttttgtgaaacgtgtgtttttatccttttcacatttttttctattgaaatgttttctttataaatataaatgtgtttttggtatgaaaataataactggccagatgcggtggctcacacctgtaatcccagcactttgagaggccgaggtgggtggatcacctggcctcaggagttcgggaccagcctggccagcatagtgaaaccccatctctactaaaactacaaaattagctggcgtggtagcacgtgccctgtaatccaagctacttgggaggctgagacaggagactcagtcgaacctaggaggcagaagttgcagcaagccaagatcacgctattgcactccagcctgggcaaaaagagcgaaactctgtctcaaaaagaagaaaaaaaatagtaactctttgtgaatagtatcaactaaaatatttatatttcagttttcattctgatattttgtttcatcagaattttttaaagtattttgtttaatatattaactttaataatttcattaactgtctcgtgcttacaaagtctttatgcatttggggattatgtaaagcatctacctttacacttttaatgagtttcagaggttttttggtacctttgagttataatacaaaaataatttatttgggtgtgatatgcagtgaattgctaacattattgcttttaattaaagattaaattccaatgttgaatgatattttctttaatttcaaaaataattagtaactgttccaggcactatctaggtttatgatgtttgaaacaaagattcttcccacacagcatttatatactagtggtaaatacaggcaataaactaataaatatgtaatgaaatatcaagtattaataatcacagtgaataaaaaataaaggcagagagatgagataggaatgattagcgaatctatttaacacaggctagttaggagccctttatttagaaggtgaaatttcatcagatccgtaaatgaagcaatggagtcactcgtaaacaacggggcagagatgtttaagcagaggaaacagagaaagttaaaagctgtgagactgaaagtaacttgcaacgtttgaacagcagcaagaagatctgtggccccagattgaggtgagaaagttggcaaaacagaaaatggggttagaaatggagccaagaacaggtcgtataatatcatgatggtcctgggaaggaccagggacaggcagaggtgtgtttaagaaagggaagacaaaagtatacacggcactcaagagagtgcatgtgcacttagaaaaagaaaggaagtctcagccaatgtttggcccctgtcttctaagaactcttcaggaagtttaccaggcatgctcacagtctgttctgactgtagcctggcttcccctccccaccccaccccaccatacaactcccagcaacagacagcactcagagaatctccagagagtgaagggccccaaagctttgactctccttgcttcttggttaatcccactctgagatatcactggaggacggacagagaggaaagacatttggaacaggtatatgattatcactgagaaggcttgagcgagaatgcaggaaagggtttgagctagtcctgatgagacatatggtgtctgggcaaggggtgtggtggaggaggagaagttggattgccgtttatacacacaggaatattggggctgggcaggttggcatggaacgctgaaactgaaatttgggactccagttgcccagtacacatctacatgaagatgatgcaaggctagtgtatacacgaatccagagttcataagagaaggcagtcctaaaatcatggttttgagaaccagtgtgtgtggaggaaacaacgggatcgcacaaggaaggagggtcaacatcttataccagaagccagtgcaggggaggctaagtttccacattatctcttcttttccattggtctttcactgaattcctttaaaatatcttgttttattgggtgtcccctcatgataattttaaacaactagtgaaacaattcttgtcttcatgtatgttcatgttcaaaataagcaagtttttgtttttcctttcagttgatctatttggctaggttcaaaagatctaactaattgtattgattagaatacaatgaaatacatttgggaagaattgatattgttaaaatgttgcagatttttataaacaagcacaataggtctcacagagatatccaaatacttagaggtcgggtctggattttgaagtaattttaataaaattcttccacaataattgagattctgagatatttttataatttaattttttggagaatatttttcatttaaaaatacttaaaaagcattaacagtgacagaaaagctattgatatatattttttcaacattaatatttatggtggaaaccctgcttaaagttctactttttttttacattttaaatgtaaactgagaaaatatttataaaaacaaaaataacattttaagaattaaactataaatatataaaacatgtcaaacattttgtaaatgatcctgaaggcaccatcagagatataaagaaatgcaagatacatgcacagaacaaaggaagaggggccaccacctttatggactggaggtcaggatatcaagccaaagaggacctcaagtcctgaaatctaacgaaacttgccctgccaggcttcaagtttgctttggctctaagacttctatttaacttccaatttctctttttcagaataggaatgtctatcctatatgtgagtgtcactgttgcattttgacagcagataacttgctgtctggtttcacaggttttaaattaacttattgagtaaaatctaagttgaataatgtgctagagaaatattcttaatacaaagagattaaaaacattagcaagatgtttgaagaggagctcctataatcgtatcccctcaaagcagcaataatatagcagcctgtctggcacaaaagtcccttggtgggaacttctggatcttgacaggaagtgtcaaaactggtgaatcccaacactgaagagagctattttgagaaggcagggccacacccaggtggcaggctcactgactgtggtcctggctacagacacagaattaacatccctctggactcagctagtgccctgtttggcattggtcctgccacctgaaccatctgccaaggggcccaggggcactcacattgaccagtaccctcaagtaacaggcctgctaaccttagttctagctctgaaccctgaagcagtccatgacccagctccagtccccctcagccatggtctgggaatagaccttcctgcacagagacctgccaggaggcaaccctgttcatgtgcctagaggcaggctctcaaaactacgtccgactgccaatcttgaagcagctctgttacttggcacccttttccattgttcaaaagcagtcctgcccactcagtgacctcctgggtgacacattgatcgatgcccctgtaaacaagactgctgacatcagtcagctggagatcctgaatcagccctcttatccagctccagcttccattcaaccacagcttggggatatcttatatcttatatttacagggactatgcaggaggtacacccatccatgcaggacagaagacctcagactcagctgtggtccatgacacagccctgagactcagttccaggtcctctcaactgtggtctggggacaatccttcttgcccagagactttcccaccaatataatgggagtccttcaagggactcaatagaatccacacccatttctgtacctcgtaagaggcatgccatctacagaaccaaatgtgaaccctgaagcagagtgtcctagcgatagccctattgaccaaggtactagaggcagtcttctctaccaagagaccagacaggatttatactcaactcgacttctggtaacaagcttgccaactaaaaattctgctgtagactcaggagtagccacatgacatggctctaaccctgctcaactgcagtcctggaggtaattcttattagcctagagaaatgacaggagaatgtctttacctaccgaaaccagtctatgcagaccagaagagctgtttgcaacttcaaatgtgcacacatcaatgcatagctacttgagtcacaaaaaatcaggcaaatgtgacaccaaagtaataaataaataccaccaaagtaataaagcttcattaagcaaccccaaggaaatggaaatctatgaattgcctaagaattttaaaatcatattaaataggatcaaagagcttcaaaatagcagagatctaaaactaataaaaaaatgcataaacaaaatgagaaatataataaagacattgacatcataaaaggaaagaattcttgtgctgagaagatttgtagtcaaatttggaacactctagtactgtaatggaggtgtgtaaatctcgttaactttagtgtaaagcttgtaaaatattctgaatacaattatggaagtgagaaggtcaacagagtactttaataacatatttcatcatacagcgaaaggaagcaatgaacttgagtttagatcatacagttagaggaacaaaaaaaataaaatgcagaagcatctgggaactataagacaacatcaagcaaatatatatgtgtattatgacattcacagaaggagaagagagaaaaacagaaagctaaaatgacaacatttcctaaatttgtgagggatagggacatgcagattcataaagttcaaaggaacccaagcaagaacaaaccaaaacattatacctgagacatattatgatcagtttgtcaaaagtcaaagacaattctataatttggaaaaatatggatgagcccagaggacaatattttaaataaaataagcctggtataggacaaatattgcacaatttcatttatatgtgaagtgtccaatagtcaaacacatagaaacaaagaataaaatggtggttaccagagtttggagtgaggaaggaaaagagaagatgtgggtcaaaggatacaaaattttatttaagcaggagaaataagttcaggaggtttatggtacatcatgctgactacagtttcaacaattatgtacttgaaaattgctaagaaagtaggtataagagtactcagcacatgaaatgattacttgaacccaggaggcggaggttgcagtgagccgaggtcatgccactgcactccagcctgggcaacagagtaagactttgtcttaaaaaaaaaaaaaaaaaaaaactcccaagaaaagcctaggactagaagacttcatgatgaattcatccaagcacttaaagaactaacacatatcctcctctgattttttcaaaacattgaagggcaaaaacacttccaaattcatttactgaagccaacattacctttaaaccaaagccagataagaacactaactcccaaaatattataggtcaatattcctgacaaacagctttcataatttttggtaaaaattaacaaaatactaacaaaccaaagcagtgcattaaaaggatacttcaccttaatcaagtgggattattcctaggatgtataaaccaaaagtatgtcagacaggtctcaatcagattgaaagtttatttcaccaaggtaaaggacatgcttggaaaaaagaacacaattacagaaacagtctgtggtctgtgcttttctttaaagataattttgaggactttaatatttaaaggggaaagcaggctagaggggaaagagggagagtatgataatccacaggttgcaagaagaaaagaagcaaagaagcaggtaggtgaatagtcatttatgtattcctttcacactcagtagaaggatcatcgctttacgtcaggtaaggagaatgtggagttactgcctgttactctaacattttatcagtagttaactgattaggaacaaaaaacaaaaaccaaaggaaatgcagtttcttgcataactcagctttcagcttagtatcttttttccttttggcatagtaaattggggtcccaagtttttttcccacagatgcaaagatggttcaacatacaccaatcaataaatatgatatgccacattaacagaataaatgacaaaaacaattgtgcatctcaatagacatagaaaaagcattggataaaattcaacatcttttcatgataaaaactcagcagatttgttatagaaggaatgtgcctttacataataaatctcacagctaaatcatactcgatggagagaaacagattttccgctaagatcaggaagaagacaagagtgctcactctcactgcttctattcaacataataccggaaactagccagagcaattaggcaataaaaagaaagaaaaggctttcaaatcagaggaagttaaattatcttgccatctgtttgcagatgacatgattttacatataaaaaactctaaagactccaccaaaatcccatcagagttaaagaattcaagaaacttgcaggatacaaaataaacatatataaatgagttgtatttctatacaccaaaaaggaaccatccaaatatgtaattaagaaaagaataccattcccaataccatccaatagaataaaatacataggaataaatacagctgagggagtgaaagatctgttcactaaagaggagataaataagtgggaggatatctcatgttaatgggttagaataactaatattctttaaatgtccatattactccagaaaatgtctgattcagtataaccccaactaaaattccacaggcattttttacataaatagaataaaacaactctagaaattttgtgaatgcacaaaaatatcaaatagccaaagcaatattgataaaaagaacaaagctggaggcttgactccgatttcaaactatattacaaattatagaaataaagccatgcttatatggtcaattagtctttgatgagggtgccaaaaatgcagcatgaagaaaggatagtctgttcaataaatggcattgggaaaaccagatacatacatgcagaggaacgaaattggactcttatcctacactattcccccaaaaccaaatctaaatggatcgaagacttaaatggaagacctggacttgtaaaagtcctagatgatgacatagggaaacagctctttgacattgatcttggccgtgatatttttgatatgacacaaaaattaaggcaacaaaagcaaaataagcaagtaggactgcatcaacatgcaaaaacttttgcacagaaaaggaaacaataaaatgaaaaggtaatctctgcaatgggagaacatatctgcaaaccatattttggataaggagttagcatccaaaatataaaagaaactgacaaaatcattagcaaatatcaaattacccaacttaaaaatggtaaagacagtgtgaataggcatttttccaaagaggcaatacaaatagccaacaggtgaatgaaaagatgttcaacatcactaatcatcagggccacacaaatcaaaaccacaatgagatatcagctcacacctgctaggatggctattaccaggcaatacatagcaagtgctgtcaagtgtgtgtaggaaatggaacacttgtacatgtgcattgctggtagaaacgtaagttgcaacagcctgtgttgaaagctgtatgacagttctataaagattaaaaatagagctactctataattcagcaatcccactctgtacaccttcctgaggtaaataattatataaataatataatgacaacataagaacattgttaaattagtcatctgtggtgtccatttgagcagttttgcccatttatttaattacagcaatttctgaaaccaaattttacctacctctaacaaccccctcttacaagtgatatttctgcaccacttggtggaatttacttccaaattcagatctctgtacacaaactcagacaaactcctttcatgcactgcaggaataattttcagtgagaagcaaaagtgttcggtcgatgtgtcatgtaaagcaagtacttgtcatttctctcgaagatgcgataggcatgggaacacctggcttccattcattgtcggtaaatcaggcatggtcagggctgtgccaaggggaagtaaattaacagcttcacgatacagctcgagattcagcttcttgcatattaattagaacaaatgtatttctttcctaatttctcacgttccagaaatactacacccatgaattattttgttaatgaaaatgatagtgatctgatgctcatagatttacagaagttacgtttgtagcatgatatacatctggcaaactaaaggttagtgacaagtttataaccattttgctggttttcccagtttcagaagaaacatgccgagggggttaagctttcctaagtctccattatcgcacgcgactgttatgatatttattgtaaacatagtagaccattgtctggaatagactaaatcctaaagaaactaaatctggaactacttttatttacatactatgaaatagatgaacctattctttgaattttgaaatggattcatttttggtttaggtggttccaatggccaatgctaaaactactggtgtttacactacaaagttcacttcagcctttggagaaaatgcgtttctttgtacttactgagatacaatagcagaaacactgaccccagtggctgccaatgtgaaccgaggtttacaatgtattgcaaagggagggagcagccaatactcctcctctagggctctgctaggattctaagtctttacaatgagtctcttcgaggggtaaagtgtttaagaccaagtctcatactaaaatgctcaatgaacctgggatgggagataagataaaaggcactctataaggtctttcataggtcagctactgcagtgcagttaaaaacactctaaagatattaaatctaatgagataaatgggagcaataagcagtatggagggaaaacgccacgtataagaaagaaggaaaatatgagtgggctttgtgctggggacccggagacctgagggcaaaagagaggagagatagggagtaacggaattatagaaagaggaggggacaatgcttgtcctttactacttttcttggttcattcttgactgcatcatgctcctcagagccctggtgacatctttgttgcggagactgtaaatgagggggttcagcacaggagtgaagatggtgtaaaaggcagacaccatcatgtcctgctcagctgtgtggtaggaactccggagcatgtaggtgtagaaggaagcaccgaagagcagcagcactatgatcatgtgggaggagcaggtggccaaggccttcctgcggccggcggcagaattcatcctgtggatgagatgcaggatgagggtgtatgagctggagatgaccatgatgggggtgagaagcatgaggatgcagcacaggtacgtgagcatcttatagagggagacgtcagagcaggagagcttcagcagggcaggagtctcacagaaaaaactcaggattttcctagactggcaaaaggggaagctcatggtaatgggggtgagcaacaaaccatcaaccattcccaaaacccagcaggctgacaccaggagctggcacaccctctggttcatcagcagtgggtaatggagaggtctgcaaacagcagcatatcggtcataggccatggcagccaggaggaaaacctcagctccagccagggtcaggtggaagaacatctggatcccacagcctgacggggaaatggtatcatctccagtgacctggcccacaagcatcttgggcacagtcacgcataggtacatgagatccatgagcgcgagctggctgatgaagaagtacatgggggtgtggaggcggggctctgagtggatgaggaggatgaggagggcattcccagtgagggccatcaagaaaagaaggaaggtcacggtgtagaggagggcagcatgcttgctctcagcaaagagtcccgtgagggtgaaatcagtgcttgctgtttgattctgagaagtctgattccctgagcacatgactggctcacagtttccccctgaggaaaaaaaagtcattaattttaaatctttcctatgtacatggctttcctaacctttttctggtaagacatgtgctttgaattatttttctaaatattgagttaaactgacataaaatcataagttcaaatcttaggtcaagtcgcatgttggccacaagctaaagtgaactacgaaacagatctggggaggtgactattcctgagctaagtcaagagtgaagacaggtacactctatgtcttatttccccccagaattaagaacacaagtatactggccttgtgggatggttagagactgaagtagggaatgcacgttaggtctgtaacacagtgttagtgttgggttgagattttcactactttttggatacagtagctcatccaggactcagtgatggaaatcatggctgataaggttaatattaatattgttaatggtacaaatatcataactaataccatgaaataatctgaaaactggaaatctccttaaatttcttctaccattatatatctccatttaagtccactttcctcatgaaaacttttcaatttattctgctattcctcacaaggttgcattccataagtagtgctgactggggcagaggagcagagggagagtcccgcctgcctgaggagagtagcttggagtgcagaacgagtgccgagcaggagagcagcagtaggcacagtgagccctcttcccagtccccagtgaaatctaaggcatttaatttattaactgtcaggcagagaaatatttttacaagaaatcacagcaataaatgctgcagatgccctaaatatcaagtatttatttgaaatataaacaaaatatttattttcaaaatgccatatttatcccccaaaatcatgcctaaaatgtccaaaattccgtgcatggtgattgaaaaatgaagttaaagcacatgaggcagttgtgttgaatctttcataaaaccgcagccctgcaaccaagcctagggatcctcttgtcctgcatctcctttgcataacaaactaatcaccaccccctcccataaattcatagctttgctcagtgactgctttgtctgaatatttcagttttaattttccagttgaattgtttcaatcatgcttgatacaattgtctcaaagttaaaaagcccactaacttctagactaatgaagagtcaggagctccatgactgaggtttggtcatcctcagggttgctgtactgcaggttagagaaataatgctgaggaaaaaactaacagtgactgaggcacgtggaaatgcaaagtgaaatacaacgcactgttcctagggcaaaaaaaaaaaaaaaaaaaaaaaaaaaaacaacaacaaaaacaaaaccatacacacaaaacaagagaccaaaaaaaaaaaacaaaacctgggacttcaggaaacctaaagtcagaattacaaagagctagcaacaagagtcaggtatctttgttccttacttatcccctttataaagcactgaagaaacgggttatcaagacacctttccacaaagagacgaacattgcacatagagcacaaaccatttgctccacctcttctgctccatcagagaataaatctaagccacgccagctcagtgaagctgctttcaccattctaaggccaaagcaaaggggtttaaattcagaatgaaaatgagaaaattacatcatcagtttcttcacattagggaattgagatgagtgtttattgcttaattctttgcaccgttttcccttttttttttctgcttattcatcttccctgtacttggcattgtctcttccctggagcttctactttctttaagaccatctcagaatccattattttggtatttttgttttgttttgctatttgtttttgatagttatattctaactttccagttacagtccacgtggtaattaaacatgtttttcatttatgcgatgcgtctatccaaaagcaaatccatctttttcatgacattgcacatttttaaacaacttcatttttctagtttaaaattatattttcgtatcggacatttaaagtaagctctttgtaaaagcaaatctgaatttcacaaagggaggatcatggaaaaccagtgtcagaaatctgtaaactaaatataaaatcctaagacccctaatcaactgaacagacccccttctaggacaagagaatctcaggaaagctgaaaagcttaattgcaggacataacaagaagggagacacacttcattatacccctgtctgttggaatttaggcacaactgaccagcaataacattgaaatagagttcctaagactgacaaaacagactctgagtggcaataagataccaaattccaacctgactctagtatagcatcacatgacagatagcagaccctgaggaaaatcaaaatattccaccccaaagtatgtctttgacatattttgaaatggccctacaaagccatctttcgtggggaaaagttgcatctatagagactttccattaacacagcaggggctttcccagattcaggagaaaatatcggagtctgacaacatttaaggttctaaaagaaacatttaccatttattatatttgcttccaattaattgtgtaatcttagtcaagaccctaaaagctctgagtgtcacttcctcaatcaaataaaaggaggagtgttatgtacttgctatgcttctgtgactcttaagacatctatgaatctgatgaccgaatgtggtctaagatttctccatgacagggtgaccttctcccacatcgcccctctccttaaaggctcagagacttcccttgaaatattagtctcatcgaatttagattatataatttgggaatgaaaaagaatggaaaaagggagccacttttctcagtgcctgcaaggttccgagactttgctgagtctttctagcatgacaaacgtacaaatactgagtagtgtattcatccctgtgtacagtcatccctcactatctgtcctcagtaccaggacatcgtgaaaataccaaaatccatgatgctaaagaccctaatatgaaatggcagagtatttctatataacctacaccaatcttctcgtatgcttgaaatcatgtctagattacttataacaactaatgcaatatgaatgctatgtaaatagccgttatactattttttttttacgaaataatgacaaggaaaaaaagtctggaggatggaacaagatgacagaatagaagtttccactgatcatccccctgcaagaacaccaatttaaaaactacctacacaaaaaacacctttacaagaaccaaaaatcgggtgagcactcacagtacatggagttaaattcatatttctgaatgaggcattgaagaagttagaaaaacagtattgcatcactgacactaccactccttcatcccccagcagtggaggtgtggtatggagagcttctctgtgcactggggagagggagagccagcaattctaagacactgaactcagcaatgcccttgttatagcagaaagaagacccagaccaaattcagctgacacccaccatgaagggtgcatttaaatcagccattgctggaagggaattgcgaatcccagtgtttggaacttgagttacccaagcctcaccatgaagggctaaagtggctctggagccacagacaaacctgaagggcagtctaggccacaagagctgcaaatcctaatgctaatctgggcccagagccagtggactcaggggacacatgacctgttaaaacaccagccagggcagctaaactcatcccctaacctcagcctccacggcttgtggctccaaaagaggcctctttcctctgctttaggagaggagagggaagagtgaggaggactttgtcttgcatcttggataccagctcagccacatcagggttggataccagccagagtcatgagggccttgggtgagactctgagacatgctggcttcaggtgagactcagcatattaccagctatggtggctatggggcaagactccttctgcttgaggaaagtggacagaaaattaaaggagattttgtcttgcactttagtgcaactattgttaccattgttattcaacatattactggaagttctagctagagcaatcagacaagagaaacaaacatatatatatatatatatatatatatatatatatatatatatacacacacacacacacacacacacacacacacacacacacacacatgcatacggcatcaaacgtcaaagaaaagtaaaattatctttgttcacagatgataggaccttatgcttggaaaaacctaaagtctccccaaaaacctattagaactaataaacaaattcaggaaagttgcaggatacaaaatcaacatacaaaaggcagatttctataagtcaatagcaaatagattaaaacaaatttaaaaagtaatggcatttatgatagccacaaataaaattaaagaggaattaaccaaagaagtgaaagagttctataatgataactataaaacagtaataattgaagaggacactaaaaaatgaaaagatattccaggttcatgaaccaaaagaatcaatattgttaaaatatccatagtactcaaagcaatctatagattcaatgttatccttatcaaaataccaatgacatttcttacagatatagaagacactatcctatcatttgtatgaaggcacaaaacacccagaggagccaaaattattctaagcaaaaccgccaaccaaccaacccaccaaaactggaggaatcccattgcctgacttcaaattatactacagagctaccataaccaaaacagcatggtgctggcataaatgcagatacatagaccaatgaaacagaatagagaactcagaaacaaatccacacacctacagtgaactcattttctacaaaggtgcaaggaacatacaccagggaaaagatcatctcttcaataagcagcactgggaaaagtggatatctatatgaagaaaaatgaaactagtcccgtctctcgccatatacaaagatatagtcaaaatggactaaagactttaagacctcaaactatgaaactaccagaagaaaacattggagaaaatctccaggatatttgtctgggcaaatatttcttgagtaatactccataacacagacaaccaaagcaaacatggacaaatgagagcacattttgttaaaaagcttctgcacagtgaaggaaataaatcaacaaagagacatcccacaaaatggaagaaaatgttttcaaactacccacctgacaaggaattaataaccgcaatacatagggagctcaaacaaatctataggaaaaaatataataatctgatttatatactgataaaagattgaatacacatttctcaaaagacaacatacaaatcaaaaacaggcacataaaaagtgctcaacattgatcagagaaatgcagatcaaagctacaatgagataccatctcatcccaattaaaatggctcttatacaaaagacatgcaaaaataaatgctggtgaggacatggagaaaagggaaccctcataaactctgtgggaatgtgaagttgcatttaaagttgtatttaaaggtgcaacagagaacagtttggaggttcctcaaaaaactaagaatagagctaacgtattatccagcaatcccactgctgggtatatagccaaaagaaaagaaatcaatatactgaagagacatctacacttccatgtttgttgcagctctgttcacaatagctacaatttggaagcaacctatgtgttcgtcaacagatgaatgggtaaagaaaatgtggtacttatacatgatagtgtactatatagccacaaaacaatgaaatcctgtcatttgcaacaacatagatggaattggaggtcattatgctaagtcaaataagccaggcacagaaagacaaacattgcatgttctcagttatttgtggcaccttaaaatcaaaacaattggacttatggagatataaattagaaatatgcttagcagatactgggaagggtactgggggggggtgaaggggtaggtggggatggttaatggatacaacaaagttgttagaatgaataagtactagcataatagactgacattgtcaataacaatcgtacatttaaaaataactaaaaggatatagtaatattgtaacacaaaagataaatgcttgagaggatactccatttttcatcatgcatttattatacattgcattcctgtatcaaaacatctcatgtaccccgtaaatgtatacacctatgtcacaacaaaaataaaatttagaaaagtctgtaccaatgtgaccatgataagcctaattatattttcaatccatgattggttaagtccatgattggttgaatcttcagatgcagaatccaactcataagcccaactgcagaagcagatactgacaccaggagacagaatgagcatattctgtccttggctggtacccaccctatcttccaacattgcttcttccaatatctcagagtatccttaaaccacacactttcatattccttcataacttcttgtatcctgcttccttgctgtgaatttaccaaatgcatttctgtataaactctaccagtcataaacacttagataatatgacaatttctttatgaaggcgtgctctactcaatcagtgagaactctcacacctcagacataacaatccttcttttatacccttcacacaagcctcaactcactcttgtattttaattatttctaagtttcaatgaaaattccacatgaatatgtataattagaaattactttaatgagctgtataggtatgaaagttaaaaaactaaataagtgtttaaaaatcgcaggtggagggttgataatacgtaaaattgcaaaattctagatacattttaggtactgctatgaaatccttaatgagctgtacacttattttttttatggatatacttcaatagttgtacaagcttcatgtatagccacaaatataaacatattcaagaacataaaatgacaaaatggtcaacaaatttatcatcttaggtccttgagggacttttgatgagtggaccctgagtaccatctgacagatttacaatgtgaacatcacataaacaatgtttttgtgcagcttgagatgttactatggcattaccttgtgcattctgactgatccataattatatttaaaatttgcaacagtgctccctattttatgttcataacatatatcatcatctggcatgaccacatcatatgttttacctattcactgtttgggtttttgttattgcacaaggagaccaaaatatattcattttcttctctgttgctttctaacattagcactatgcctggcatatatcactttcgcaccaacataatagtaaaaattgattatttgttaaataaatgaagaagggaaaatgatggttagagagattagtgcaactcctttagagatgaatttagtaatatctcataacattgaagatgttctttcttcactacctaagacttccaaggagattatacgaggatagacactctgttacactataaagcatgaaaaaagtggtaaacctaaatattcatataaagaaaatgcacacatgaccaatattaataccaatttattgtgaacatttcaataagtaaagttgaaggaaaatatatgtggcagaatgatcagtgtgttaccatttaacaaatacatcctgctaaaatattacatttggacacatatctgcaataaaaacattaaaaattgatagggaagatacacacctactgtttaaaaaaattggtctgaggacactaagagagggaattcaggagagcacagataagactttgatgtacctgtaaaatatatacccccatttttgagtcagggtcttgctctgtcacccaggctggagtgcagtgtcacagttgtggctcactgcagcttcaatctcccaggctcaagtgatcctctcacctcagcctcctgagtagctaggactatagacacgtgccactatgcctccctaatttttttaaatttaatttttggagagatgaggtctcactatgttacccaggctggtctcaaatacttaggctcaagcaatcttcccacctcagccttccaaagtgttgggattatagggcataagccactgcccctggatgatgtacctatgatatatatatatttttttatttcaataggtttttggggaacagttggtgtttggttacattaagttctttagtggcaatttgagaatttggtgcactcatcacccaagtagtgtacactgtacccgatgtgtagtcttttatccctcacctgctcccaccctttcccccaagtccccaaagtctattgtatcattattatccctttgtatcctcatagcttagctcccaggtgtgagtgagaacaatgtttggtttttcattcctgagttgcttcacttggaataatggtctctaattacatctagtttgctgcaaatgccattatttcattccttttcatggctaagtaatattcatatatatatatatatatgcatatataggaatatatgtatatatgtgtatatatgtatatataaatatatgtatatgaatatatgtatgtgaatatatgaatatatatgaatatatgaatatatacgaatatgagaatatatgaatatatatgattttctttatccactcattgattgatgatcatttgggctgcttccatatttttgcaattgtgaagtgtggtgctgtaaacatgtgtaagtatcttttgaatacaatgacttattttcctctgggtacacaccaagtagtgggattgctggatcaaatggtagatatacttttagatctttaaggaatctccagacttttccatagtggttgtacaagtttacatttgcaccagcagtgtaaaagagttcccttttcagcacatccacaccaatgtctatttttaaaaaattttttgattatggccattcttgcaggagtgagatggtattgcattgcggttttgaatttcatttccctgataattagtgatgttgagcatttttttcatgtttgttggccatttgtatattttctcttgagaattgtctatttgtgtccttagcccactttttaatggctttgttttgttcttgctgatttgagtttcttgtagattctagatattagtcctttgttggatgtagagactgaagattttctcccactccatgggttgtctgtttactctgatgattatgtcttttgctgtgcacaagctttttagtttaattaagtcccatttatttttgtttttattgcatttgcttttgggttcttggtcatgaagtctttgcctaagccaatgtctacaagttaacattttctgacgttattttccagatttttaataatttcaggtcttaggtttaagtctttgatctatcctgagttgttttttctataaggttagagatgaggttccagtttcattctttacatgtggcttgccaattttctcagcaccatttgttgaatagggtgtcctttccccacttttatgtttttgtttgctttgttgaagatcagttggctgtagtatttggttttatttctgggttctctatactgttccattggtctatatactgatttttatgccagtaccaagctattttggtgactatggccttatagtatagtttgaagtcgagtaatgtgatgcctctggtttcgttctcttttcctagtcttgctttggctatgtgggctttttggttccatatgaattttaggattgtttaggattgtttttctgtgaagaatgatggtggtgttttgatgggaagtgcattgaatttgtccattgctttggcaatatggtcattttcaattattgattctactcacccataagcatgggatgtgtttcaatttatttgtgtcatctatgatctctttcagcagtgatttgtagttttcctcatagaggtcttttacctccttggttaggtattcctaagtattttattttgcagctattgtaaattgggttgagctcttgatttgcatctcagcttggtggctattgctgtattaacagagctactgagtcgtgtacattaattttgtattctgaaactttgctgacttcatttaccagttccaggagctttttggatgagtctttagggttttcttggtatacgatcatattatcagcaaaccgacagcataacttcctctttactgatttagatgccctttacttctttctcttgtctgattgctctggctaggacttccagaactatattgaatataagtggccaaaatgggcatccttgccttgttccagttctcagagggaatgccttcaacttttccccattcagaataatgtttgctgtggatttgtcataggtgacttttattaccttacagtgtgtcccttgtatgctgattttgctgagggttttaatcataaagggatggattttgtcaaatgctttttctgcaactattgagatacacagaattaaaaacaaaagtcacatggttatgcgatgtatcacgagttgactcatatatgttaaatcaaccctgcatccctgttacgaaacccacttgatcatgatgatttatctttttgatatgttgttggattctgttagacagtattttgttgagaatttttgcatgtatgttcatcagggatattggtctatagttttgttatgtcctttcctgggtttggtattagggtgatactggcttcatagaatgatgtaggaagttttccctctatcttgtggaatagtgtcagtaggattgatgccaattaattcagctgtgaatccatctggtcccagactttttttgctggcattttttaattaccattccaatcttgctgcttgttactggtctcttcagagtttctatttcttctttgtttaatctaggagcattgtatatttccagaaattaattcatctcctgtaggttttctactttacacgcataaagctgttcatagtagccacgaataagcttttgtatttctgtgatattggttgtcatatcacctgtttcatttctaattgagcttatttggctattctcttgattaatcttgctaacagtatcaattttacttattttttcaaagaacctacgttgtttcatatagcttttgtattttttatttcaatttcatttagttctgctctgatgtttgttatttcttttcttctgctgggtttgggtttggtttgttcttgtttctctagttccttgaggtgtgaccttagattgcctatttgtgctctttcagactttttgatgtgggcattaatagtatgaaccccatgtgattcaggaattccattactaaggatgtatccaatttaattgggcatgtcaaagagatatctgcactcccatgttcattgcaacattattcacaatagtcaagatatggaatcaacctaagtatccatcaatggatgaatagatatagaaaacaagacatatatccacagtgaaatgtaattcagcctttaaatagaagaaaatcttgttcatgtgtcaatgttctatattgtgttgtatatatcaaaacattataattgtatatataatacatatgtgtatataatgtatattatatataatacataattacaattatatgtgtaatatatatgtgttgtatatatcaaaattgctaagtgggtacattttaaatgtctcaccatgaaaattggtgataatatgttcattaggttaatttcatcattacaaataatattcgtatattaaaatatcacattctaccccataaaaatctatattttaatatttcaattaaaaatatttttaaaaataatgcaataagaacatgaaagtagaaaaatgattatagacctttggtgtggaactgaaatcagaaacacaaatattaacctatgatttctacatacatttataaataattgatggtgtctacttcattctttactcgttttctttccacattttgtagatataatttgagatttttttattctatcttcttgaaataggagattagtcaatatttaacctttcttcttaatgatctacagggataaatttttctgtaaccactgcgttagctgcatcctacacgttttatgtcatgtttatattattgttctgtcaaaggcccacctgtgtttgattttggtgagaatcccacgtgaactagaaaagaacttgacttttcttattgttgtgagcattgttccatatgtacaaagttttgttaccattaagtatgttgtataaatcttctataactttagtaatttggaggtttctgtgctctatcacatattggcatgttaacatatatactattaaattgagcaatgactgggcaaaaggaaaaatcaaaagagaattaaaatctcaagacagacaaaaaatacactatactaaaacttatgagatgcaccaaacccagtactaagagaaaagttgattgcaatgaatagctacatgaaaaaaagaattcaaattaaccaactaactttatatatcaagaaactagaaatagagagcctaagtccaaagttataatacagaagaaaacattaaagtagaaatgagactagaaaaactaaagaaaaatcagcaaatctaaattgttttttaaaaatttaaaggtgataaaccttagctagactaagaaaaagagtatcctcaactaaaatgagaaataggaggagtcattagaacaaatgcctcaaaatgaaaaggatcataaaagactattatgaaaactatgcacttataaattagataatctataagaaatcaaacttgatttatgcaacctaccaaaactaaatcaagaggaaataggaagcctgaacagaggaagaagatcaaattagtaaacaaaaacttcccaaagaaaagaccgaaccaaatggcttcgtggatgaattctaaacattcaaagaactaatagcaatccttcttaaactctttcaaaaaccaggagaatgccccaaactcattttatgaggccatcaaacacttatatcaaagccagacaaagataatcaaaagaaaataaaactacaggtcaatatcactgataaacataggtgtaaaaatcttcaacaaaatactaacaaaccaaattcaacagcccattaaaaagagaataaaccatagccaactgaaatgtatctctgggatgcaagaatgcttcaacataggcaaatcactcagtgtgatataacacattaagagaataaaaaaaaattgcagcaaaagcatttgacagttcatgtcaaaactctgaaaaacaggtatagaaggaacttatttcaacacaacatatcatatatgaaaagcccacagttaacataataaaaaatgaaaatgtttctcctatggtctggtacaaagcaaggatgttcattgtcaccacttttatttaacatggtactgaaagtcctatccaaagcaattagacaaaaaagcatcaaaattagaaaaatattaaaataatctctgtgcaggtgacatggccatatatataaaaaccctaagactacaccaaaaaactattcgaataaacaaattcagtaaagttgcagaacataaaatagcacacaaaaatcagtgacatttctgcacacaaacgatgagctatttgaaggaaaataagaaagcaatcccatttaaaatagcaaaaaataatatatttaggaatacttatccaatagggcagaagactcctacactaaaaatcataataccttagtcaaagatattgaaggagacacaaataaatggaaagacactgtattcattcatttgaataattaacaaatcttcaaatttgtagatttgaataattaacattgtttaaaatgtccttattaagcaaaacaatctataaattgcaatttctataaaatatcaccggtatttctttacagaaataaaaaaacaataagtaactacatctagaaccataaaagatctcaaatagccaaatcaaccttgaacaaaactagaggcatcacattgatttcaaaatatattacaaaggtatgggaattatcactgtaaagaactgtcataaaaaagaaaaatggacatatagactaatgaaacacaatacggagaacagaaagcaacccgagcatatttggccaactgatcaacaaagtgagaaggcaacctacagaatgggagaaaatatctgcaaaccatatatctgtaaagagggtaatatccagaacttataaggagctcaaacaactcaatagcaaaaaccaattaccttgattaaaaataagcaaagggcctgggtaggcatttctcaaaagacgacataaaaatggccaccaggtaaataaaaagagctgaacatcactaagcatcaggcaaatgcaaactaaaaccacaacgaggtatcacctcccaccggttagaatagccatcattacagatcaaacaaaagagagggaaagtggagaaaaagaaacctttgaatattgttggtgagaatgaaaattggcacagcaattataagcaaacagtacagagtttcttcaaaaagttaaaaatagtactatcatatggtctagcagtcatgcttctaggtaatggttcacccaaagaagtgaaagcgggatttcaaagaggtatcagcacaccagtgtttattgcagcattattcacaatagcaaaaatagaaaaataactgtaaatgaatgaaaatgtaatgaaaatataaatacacatacttgcacaatgaaatattctttattttttagcccaaagtaaatcctgccatttggcacaacatgaatgaacctgaactatattatgctaagtgaaaaatacacagaaagacaaataccatatattctcacttatctaaaatagtagactagctcatagaaacagtagcatgttggtcccccgtgaggagtttagggaaacgaataaagactggtcaaatgctacaaagttcagtcatgcaaaagtgaataatttctagagggctaatatacagcatggtgactatagttagcaatattgtcttgtatacttgacatctgttaagagaataaatcttgtatacttgacatttgttaagaggatatcttaagtgttctaaccacaccaaaaaaaaaataactgtgaggtgatggaaatgttaacgagcttgatggtggtcatgatttcataatgtatgaaatatatgtacataatgtatgaaataatgtcggaagacaccgacacgccgcgccgccggagccccagtgcatgctggttgcgctgaaggcgaccccgccccagaatgcacggagcctccgcccaggccccggaaggacaatgtgcccgacaactggcgatggctgtaggaagccatggtgaggcgggggatggatggaaccaccctgggcccagcagctgtgattggcaggaggagccacatctttcattcttacagcctcagtctctctgcatccttatacttaaggtgtctgtaatcataatattgtataatctgataatctcagtattttacttggaacatttagtatattacatattttattgatacataatatttctacatacttatggggcacatgtgatattttgatacatgcatgcaatgtgtaataattactgatataattggggttctatgtgagctataacttctaaccatattctatttggcccatctgtttcacgtctctttttcattctttcgttgcttcttttagaaatataaaaatctatcattttttcattttataaacttgttttggcgtttactataaacattacagcatgtactcttgatttactaaagtttaacacaaattactacctctactacatcaatattgatatatcttcaacatgatttttcatacatttaagttttgcacaaatctaaactgtatattacattaaaattattgctaagtcaatattgattatgactcatttacatattactctttggggttgatgtttgtcatttttgcttatatttctgagtttacttttgagataatttttctatggctgaagaattttatccacttttgtttgttggaaaaatttattttactatcattttttataattggagttagactcaatctacatctagttcatccctattactgagacatggtcctactggactcttgattgacaggctggtagatgtccctatgctctgtcttgaaagcatttctcccaatatcaatgtggctcattaacttgtaaactccacatctttgctcaactataaccagtgaggattagcctaaatccctacataaaacgtgacccctacacactccaagacccctctcctgctcaagattttccaacacttttcttctgataatactccatgtcttcttctcaattaccaaatttattttctgtatacaccctttaagtgctaaaaaagatgaagatttttatttgttttgctcactgatgtatcctcagtttgtagaacggggcctggcaaactataggggctcagtagttatttgttgaatgaatgaatgacttggggcctaaaggaagattatgtagtcatggaaagttatcttcgtatccttgtacttacagataaaaaaacattccgaagagagggaaagccacgtgaaaacattgggtatggaaagaactatagtgtttccaaggttggagtatggccctcccagagggagaggcaatgcagtgtggaaaaggccacagactccacaagacgtggcacatgcagtggtcaggggcagggactccggcctgcctgcctgggcttaaatccctgttgagcactttataagctgcacacccttttgttcatgttactcaaacccatgggtttcagttaaatcaactgtagaataaggctaataataggctgtgaaaataaaagtgttccatacatgtcacgcactaaaaatggtgccagatcataataatcacacaagacgttataattattatgttatttgttaaatacaaatacaaccatgcacatacgtaaaactgtgatttgaaattatattctaagtatgtgtcaccattggcttgaacagggagaagtgtgcgaaacttccatatttctctggttaagtctatgaataaaccaattatactccaaacatgttgtagcccatgtctactggatagcccatgtctctgctctaattttgggaggtttgacttcttatatgctcacagaaaataagaatttgattgagaacacattctagaaattctgatggaagaaaaatctcaactgtacatttagcatctctgaggtcttgaatgtgtttatctccaaatgcctatggatgaatgaacccccttgtccctgaggatcccctgcttggggcaagtcaggggaagcctcaaaggctgttttgtcatttgtgaaatgtgggtgaccttagcctcagccacagagggtgaaggtcgaatgaggtggtgaacgaaaagcgtttagcacagagtggatgctgaggaacactctgaatatggtgttatttcatactcatcaatgggcccatgatagcaaaacaaattttctctgtggtggaaggtgctcaagggtcataaacacatttattttcatatttctccactgtaatctaaaaaaaggaccattggccccgaaggactggactagagatcaatgctacgagggaagggggggataagtgaacatcatctcaagtgtgattataggagggaagaacactgggctgaatccccctgaaggacaactcagggagtcagacactaccacaatatgctgattgtttggtggaaggacacctaaagtgaagagagactctaagaagagaggaccaacttaagttctttcacactttaatatggaggtttctgcacgctcagcatttttttcaaagcccttgtgacatccttattcctgaaactgtaaatgataggattcaagacaggtgtaaggatagtgtagaaaaaggatgacatcatatctttctcaggagtttggtaggagctggggagcatgtagttgtaaatagcagctccatagaagaggctgaccactgtaatgtgggaggagcaggtggtgaaggcctttttccgaccctcaactgagttcatcttatggatggtgaggatgatatagtagtaagacactgaaatgaccgtcacaggtatcaggagcatgatgacacagcacaagtacatgaaaatcttgtaaagtgaggtgtctgagcaagagagcttcaaaacagcagggacctcacagaagaagtgctgaatctcatgggatctgcagaaggggaagctcatggcgatgggagtgagcatgaagccatccactgagcccacaaaccagcagcctgatgccaggaggagacataccctatggctcatgagcacagagtaacggagaggatggcagatagccacatagcggtcataggccatggcggctagaaggcagcactctgcacctcccaactgcaggtagaagtacatctgggtgccacacccaaggaccgagatggtcttgtctttggccagctggttcaccagcattttggggacagtgacagaaatatatgtcaagtctatgagtgagagctggtttataaagaagtacatgggagtatgcagagaggagtcaatgtggatcagaagtatcaatgtaatattccaagacacagccatcaaaaatatactgaagataagcaagcagaggcggccagggtgtgagatctggctgaagattcccaacaggaaaaagtcaccacccagggtctggttggccagccgcatgctgtatgatcggctgaagtggctttacctggaggacaaaagtaaactttatttataatcatgtgtgtaccacgtaaaagtatgtttgcttcactttaccttttaaaaatcaatgtgaaaatcagagtgtatttccaacatgaactgtgaatttgcactaaaaagagacagcacattagattgtgaatctgattccccatctagaatgggaatgaaatatttatattctcaatgaagaggtccatacaactgaaattaaattatttcctatagattatatagtcactaatagttatttttacttatatatgttcacattttgtgtgtgttagtatcttatagttgcatgttcctgtattgcccaaatcccattcccatgggattttacagagctaataaccaatatagatatttctatatatttgaccctcaagagtcatgtctgcaaaaaaggattagtaatacttgtgtttcttaaatctcgttacaaatctacgaacatacaatttttcaatacttaaaagcaatatattaagccaccagtaattgtaaacattttaaacataaaattccaaacccttatataacgttacaaatttagtcaaatttctttaaatgtattaaagacactagtacaacttgtaaatttctctaaaatgatttacttttacacatatgtgatttataaaatgtatttttatacttccacttaacctattacaaagacattaatcttgtgagttatttattcatattttcataatttccatcaagatgttctaatccgttgtgtttctgccaatctttcaagatatcaaaaaaaaattatggctatctcagatcaatgatgctttaggaatcagcattatcatccaatcagtttattctgaggtgattggtctgaacctcacttggaatttcttgatgtgaaccttctttataaaattaaagtaaaatgtaattggattttacaagcccacatcttttcttccaatctccccattttgcctgtagaattttggtgagagaaagtttgcctcaatttatacttatcttatcgtgacatccaacatatttattgtatgcaggtaggtcatcctaaggtttcttctcccagtggttcaagcatgggggtctctgaagttgcaattttttttaaagactactcaagtgcactagtgagaagggaggaaaatgtagaacaaggaattctatctgtaactggctgtgaacaatcaattgagataactatcttcagatcatccaagttccaatttcttctcagagcatctagtcaattaatcaccttgtaataggctgtaggactcttcttctacctggctattttggggggtcagtggtgctggtcagccctttcccgttgatagcactatctttctcttgttcagaattctgtgatttacatatggatgctcattattattattctctacttaaagaaaatgcatatcctttataaaatgaatagttttagatatcattaatgttcaatatattaataacgtgtcaaatgtttatttaaatcagacacatattcatcctttttatattgcagcttttcttatgtaaccttttacattgtaatgtacactttatattttttatcattaacttaaaatttataaataagaattattgcaattggtcatattatttccttttttatttcaaatatcttgccctggccaagactaaactcgtgggttttcattttgttttagaaatacttagcaaaggacacagaaagcataagagtaaagtaatgccagtttttaacaaattgctttcttatgttaagagacttaaaaccaaaggggacttaatgtattttcagtaaataaacatgtcattggccataacaaatggtagattttagtcaattaataaattactagactaataaactatattttcctggagcagaaagtaattttctaagtataaaggcaaaataaataattcccaataaacttcaaaaattcagtggaattatttagtagattccaaaagacaatgaagcaacatcatctagaaaaatttgaaaaaaaaattatggtccaagaatgaagcatatatccagcagtgaaacagcatagaggccctgtctctcagatatccaagaactcagaaagcagagaatcaggtaaaccgtttcagaaattcactatcagccctgctccagccactgtcagtcaatgtctgtcccgtcaaataaaacaactgcaaaatgtgagagtcatggtacgcctggaccaaaggcgaaacctgagacaaataaaacacacatgtgccaaattgaatgatcatcgtccatctgtatcacataatgtctcaaagaaaaatcaggaagtaggcgcaaaaggggtaaggaaaagtagacttaacggaatttccacaatttataggagataagcattttcacttgctgcccagcttctcagtgaaataagtgtatttaatgtccgctcccaaaaatggagtccatttagggacagtgtccaggataagactggtgcctgtcagagctaattaactctaggtctatgtaaggaggccccttcccaagttgaacaggtggtttacaatgagtataattatgcaaatcagcagtgagatggacatgagctagtcagggtgagcatatctcaggtttattcaggagaacaaaagtgagagtggatattgcatttcttggccatgtagttcaagctaccgttcttccacagacactgaaacaaggggactgagtccataaggctgcagaacaaaactccccttaaccaaatcaattaatttatccacttctaggaaacaaatgacaccagcacagacggccacgcaaggcaaaagaacagcaattaggttcattcaaaagcaataaaatattttaaagatgaactgctatttccaaaatgaaacctttatgacaaagcaagcaaaccagttgtgacaggcttcacagtagtaacatctgcactgtaggaaggagagcacccctccttcttgagtgggtatttatactccaaagtgatgtgtcatgcttcacccaggaagtagaattatgttgctcaccatgaggctgaaacctctatcaaccatctcccactcatccacatcttcctgttttggagtctgggagatcagttatttaaaaacaaggggaaaaaaggaggaaaggaagggagggaggaagaagagaggaaaagaaaactaatattcaacattgctccgattttcagaggaaaaaatgtttataatttaagtcagatttgcctggaaaaatataccaccaggaggaaaaggctcaagatctgaaatcagttatttttttagtttagttctcttcttttccgaggtacgttgcaagtcacctaaaacttttgagtatcttttttttccatttatacctgtaggggtacacactacttatttctacagcctaattaataggattgcagagagtttcagatataatatgcacagcaagtactttctaaattatagctttgtattaggttaaatatgcttatgagttattttatgtgatctataatataacaatgttagtataattttaccaattatatttgctgtattaaatatatattaactgttacattggtgattaatatcaattgataatataattctataatacatatattattaaaagttaataacaataaattattcctttcttactggaacaaaggaagaaatgtaataccctgaggaattttatttccaataagatacttccagtatagtcgtcccgatgaatgacagccttgtcattttcgttgtgatcaatctgctctgtgatcagtgaaacaccagcctgcttttctgcgaaagggtttcagatgatgaaacacttatgaacttgatgactctccctgaagagcagctgatgctgccgagtctaacacgtgcggtcctgggacgacaaacttgaagaatgatgctgtccacagggacccctcacagggctgtggtggcctccatgggagcagtcctgggggagtctctctggcctttgttgaatggtagggcctgattctatagacttttccaattgcctaactcctctaaccctccaaatgaaaacaagcatctactaatggcaaacagacttcaccagactgtttccttgaagacaacttcgctcacaggtcaaaccattgcatcatcttgccatgagggaaaagagtgaaacgaacctgaattagacaattgataacacatttaatagagtatattcttccatttatttattggttttcttagtaataactgtagaaaattttaaaactaagtattattataaaaaggagaaataacaacacatactataaaaagccaaagataactagagtttgaatttttcttgcttttaggcaggcattttcatgtgattttctttatagaattttgtatccatttgtctttgaaaatatgacattttaaaccaaagtgtttgcatttgagtgtccataaaatgtaaaacttatttgttatttctaatttcttatttatctcaaacaattgtgcataggaaactttttaattatgaaaatggacattcgtgattgatatcgctttgttaaatgtataaacccttttaactgaaattttcatcagaagatagggttattgctgaaaatttgaaaagcattgaataatgtaaataatacaaaataacattttttacttttaacccttagaagcaccaatttaggaataatgtaacatttccctccaggatgtgtttggagacaactgatatatccaaaaatttggtttttgcatttcaaacagaagattatagaatggcctttacactgtagcatatgactttgaaataattaatgtagaacattggctgagtaaacacattatatgacctccctgtgtcttaagtcttcagggtgtttttcacgttttgtaacatgagtgatatttcaataaacagttctctgttcaatgtgtttattttggtggaattacaaatttgaaattccaggtgtgatggtcagaggatctatacctcttagaacattccactaaatgactttccaaaatgtaaccactattaaaagttttatagttatggccgggagcggtagctcacgcctgtaatcccagcactttgggaggccaaggcgggtggatcacgaggtcaggagatcgagaccatcctgggtaacacagtgaaacaccgtctctactaaaaatattaaaaaattaaaaattagctgggcgtagtggcgggcgcctgtaatcccaactactcaggaggctgaggcaggagaatggtgtgaacctgggaggcgaggcctgcagtgagccgagatggcaccactgcactccagcctgggcgacagagcgagactctgtctggaaaagaaaaaaaattatagttatttatggtcccaaaacaacacattcgttataaaaaatttacaaatacaaacttcaaggaaggaataatctacagaaattgaatgtgccattgaatattctagtgttttatactaaaaagtgtatcaaacgtactttaccatgtgagtgttattaacatcagtccacctccaaaaagtgtgtgcatgtcacatgaggatacgttccaagcacacggaaagtgttcagtgattgatccaatcagtagtcatgcagagtaggtgctaataaacactaccccgagtgaggatgcagacacggagacgcaaagggcataggggaatttccccaagtcagacagatgagtaacagggcagctggactcaagacagactgataagtaacaggacagctggactcaagaacgtgcttctagaaccacaatgctgcactaactcctaattgcaattcctggtaacagctgaaggatcttctgattatattgtagtccgtatttagtagactttttagaaaataaacagacaaaaaatgcaaaagtcattagcgtacagctcaagtagtctttggaaactgaactcaccacagcctgcccacagatgcacaatcagaagtgagttagcccccacgtagacccccagcctgcatcccaataccctccccaaagaaactgtgactctgccttcctataaagtagttttgcctggatttgaaatttatgtaaatagagtcacaaaacatgcactctttcatgcctaccttcttttactaaacattatgtaagattcaagcacatttacaggtagttatgttggtggttttttcattcttactctgtattgtatgctctaagaacaaagaacaatttgtttattttgttgttcatggcaacttgttttctatctatggctattataaataataccctgtgatcatttttaatttgaaattcacaacttaagaagagataatcagcacacctttacatccactaataacacacagattgcatagtacaagctaaaaggataacgcaaaaaaacaataccacagctaaactgaccattttgacttttattaattggagaaatttattgtaaatcatttaagttttataaaactatatacttttaaaaatatatattaaccactacaaaaaatttattcagtaaaatatttcacctacattttaaaacatgtattttggtaaacacatgtttgcatttctgttgcatatataaccaggagtgggatatctgggtcatagatgggcacatattcagctctatcagatactatcaaactgttttccagaggttttatcaatttatagtctcattagcagttattttaatcatcataaccacactgacagatgtgctatttcattgtggttttaaagtgtcattttttgacaactagccaagttgaaaaccttttcatacatttattggaatgtacattttgtacatttattggaataatttattggaatcatggctatcatatttgtaaattcccattctagtcttttgccatttttaagtggattttctgcttctttattgatttgtaggaatttcttctatgtgttctatatgaatccttcatacatatatctatttataaatatttccttgttttctatgggttgcttttttacaatattaattttttaaaataaattttaatttaatgaagtccaacttactatgttttcctttagtgttagcacttttgttttctgtttaagaaatacttgcttacctcatcattataatgtgttgttctatattttcttctaagagattattttaccttttatatttcaatctatacagcccatctgaaatatattttcttatcctgtagtgtagggatcaatattcattttttccatgtggattgtgcagtggagtcagaactattaaaagcatcctgcatttcccactctgagtggttgccctggtcataaatccaatgtacatgtaggtgttgatccatttctaggctttattttctgttccatctgttcatttgacaatttgcacagataccatgccgtataaattggtatagttttaaagtaaagcacatggaaattggctgccaccagcaaggaatggtggtatctgtgagaggagttgacatttgaagagtaactcccagggctttgtttgagagtgctaatttagaagagtacaaagaatggctggaaataatgtgttaatatccaccactgggagcactaacttggctgactcttccattttcaatgctaaaatttactgaaacctccaaggaaaactcatacttcacattttgaagaataaatgcctcagatggaagagagtgatattgattcaagaacctggaaaacaaaaacttataagaggcatgaagactattaatataatggaagtctttgttatgaagataaagttgtcttggaaaatcacatgaaacaataaaaagtgttattaatatggaaattaaaatgtgctgtgtgaaggagtcagtggatgaatttgaaggtttggattctccggaatttgaaaatttattcatggtcttgaactttagggtttcacttttaatgacctgtgcaaggctgagtgtagagttagtgcagcaccagttgtattcaattgttcacataaaggaatgaatgttctaaaagcagtgacaacccagtagcaatgaatgagcacacggagtgcctagatcttggtttctaaatgctaatggtagtttgtatttctgtgggatcagtggtgatatcccgtttatcatttttcattgtgtctatttgactcttctctcttctttattagtctagctagtggtccatctattttgttaatcttttaaaaaaaaaacccagttcctggattcattgattttctgaagggattttcgtgtttctatttcattcagtcttgctctcatcttagtcatttcttgtcttctgctagcttttgagtttgctcttgctcctctagttctattaattgtgatgttagggtgtcaattttagatctttccagctttctgttatgggcctttagtgttataaatttccctcttaacagtgcttgagctgtgtgtcctagagattctggtatgttgtgttttgtgctcatttggtttcagataaattatttctgccttaattttgttactcagtcattcaagaacaggttgttcagtttccatgtagttgtgcggttttgagtgagtttcttaatcctgagttctaatttgatagtactgcgatttgagagacggttacggtttccattcttttggaattgctggggagtgttttacatccagttatgtggccaattttagcatacatgctatgtggcactgagaatgtatgttctgttcatttggggtggagagtcctgtaggtgtctgttcagtccgcttggtccagcctctcttaccactcctattcaacatagtattggatgttctggccagagcaatcacgcaagagaaataaaggtattcaaataggaagagagaaagtcaaattttctgtttgcagaggacatgattgtatatttagaaaaccccatcgactcacccccagaactcaagctgataagcaacttcagcaaagtctcaggatacaaaatcaatgtgcaaaaatcacaagcaatcctgtacaccaacaatagacaagccaagaacaaaatcatgagtgaaccccattcacaattgctacaaagaataaaatacctagcaatacaatttacaagggatatgaagggcctcttcaaggagaactacaaaccactacttaaggaaataagagacaacacaaacaaatggaaaaacattccatgctcatggataggaacaattaatatcgtgaaaatggccatactgcccaaagtaattttagatccaatgcaattcccatcaagctactaatgactttcttcacagaattaggaaactatttgaaatttcatatagaaccaaaaaagagccagtagagccaaaacaatcctaagcaaaaagaagctgggggcatcacactacctaaattcaaactatactacaaggctacagtgaccaaaacagcatggtacctgtaccaaaaacagatatatagaccaatggaacagaacagagacctcagcaataacaccacatatctactaccatctgttctttgataaacctgatacaaacaagcaatgggacaaggattccctatttagtaagtggtgctgggaaaactggctagccatatgcagaaaactgaaactggacccattccttacacattatacaaaaattaactcaagatacatttaaatctttaacttaaaacccaaaaccataaaaaccctagaagaaaacctagtaataccattcaggacacagggatggacaaggacttcatgactaaaacaccaaaagcaattgcaacaaagccaaaatcaacaaatgggatttaattaaactaaagagcttctgcacagcaaaagaaactatcaccagagtgaacaagagacctacagaatgggggaaaatttttgcaagctacccatctgacaaaggtcttgtatccagaatctacaagaaagttaaacagatttacaagaaaaaacaatcccatcaaaaagtgggtgaagggtatgaacagacacttctcaaaagacatttatgtggctattaaacatggaaaaaagctcatcactggtcattagagaaatgcaaatcaaaaccacgatgagataccatctcacgccagttggaatggtgattattaaaaagtcaggaaacaacagatgctggcaaggctgtggaaaaatagaaatgcttttacactgttggtggaagtgtaaattagttcagtcattgtggaagatagtgtggaattcctcaaggatctagaaccagaaataccatttgacccagcaatctaattgctaggtatatacccaaaggattagaaatcattctactataaagacacattcacacatatgtttattgcagcactatttacaacagcaaagacttgggaccaaccaaaatgcccatcaatgatggattggataaagaaaatgtggcacatacacaccctggaatactatgcagccatgagttcatgtccttcgcagggacatggatgaagctggaagccatcattctcagcaaactaacacagaaacagaaaaccaaacaccgcatgttctcacccgtaagtgggagttgaacagtgagaacacatggacacagtgaggggagcatcacacactggggcctgttgggtggtggtgggggaaggggagggagagcattaggaaaaatacctaatgcatgtggggcttgaaacctggatgatgggttaatgggtgcagcaaatcaccatggcacattatacctatattatacctgtgtaacaaacctgcacattctacacatgtatcccagaacttaaagtaaaatttaaaaaagctctagagtctttgtgtggtgttaaaccatatctctaaacaaaatgatactaaacaaaatttaaaaatactaatatgtgtgatttgttgtttgcaactttctctcgtgttcatactcccaacgtgggtaaattcaggttgctaatatgatgtcactgaccacacagttgggaaaggatatgaataatcatatctcaccagctagtgcaagctggccccagcacaacactgcagaaatgttagaacagagactacttccaggaggagaaaataaggagggttaacaggacaaaataataggaataaatttctgaggtgagaaatgacacctgtctcaaatccaaaaggtatggtatagatactaaactgggtaaatgaacccaacatttttattttattattattactttatatttttgagacagtcttgctctgtcacttaggctggagtgcagtcgcacgatctcactgcaacctctgcctcctgggtttaagcgattatccttcctcagcctctgaagtagctggcattacaggctgtgccaccacgtccagctaatttttgtattttagtagaaacttggtttcaccatgttggccaggctgttcttgaattcctgacctcaagcgatccaccccgccttggcctcccaaaatgctgggattacaggtgtgagccactgtgcctgaccaacagtagctgtttttttctgcttctctctttcctcccaccctccatcctctagtgggatccagtgtctgttgttcccctttgtgtcctcatcatttagctcccacttacaagtgagaacatgcaatatttggttttctgttcctgtgttagtttgctaagaatgatagcctccaacttcgtccatgtttctgcaaacaacatgatctcattcttttcatgactgcatagtatcgcatgatatatatgtatcacattttctttatccagtctaccattgatgggcgtttaggtcgactctatgtctttgctattatgaacagtgctgttatgaacacatgcaagtatgtgtccttatgatagaacaatttatgttcttttgggtatataccaagtaatgagactgctgagtcgaatgctagttctgtctttatatctttgaggaattgccatagtgttattcacaatgattgaactaatttacactcccaccaccagtgcatatgttcccttttctctgcaatctcatcaacatgttattttttgactttttgataatagtcacgctgacaggtgtaagatggcttcccaatgtgggtttgattttcatttctctaatgatcacagatgttgagatttttctcatatgcttcttggccacaagaatatcttcttttgaaaagtgtctgtacatgtcctttgcctactttttaatttttttcttgtaaatttaagtttcctatagatactggacattagacctttgtcagatgcatagtttgtaaatattttctcccattctgtaagttgtctgtttattctgttgatagtttcttttgctgtgcagaagctccttagttagattccatttgtcagtttttgcttttggcatcttcatcatgaaatctttgcccattcttatatgctgaaaggtattgcctgggttgtcttctggggtttctagaggtttggattttgcatttaagtctttaattcatcttgagttgatttttgtaaatggtgtgaggaagtggtccagttctaatcttttgcatatgagtagccagttttcccagtaccatttattaaatagggagtcctctccccattgcttatgttttaagctttgtcaaagatcagatggttgttggtttgtggccttgcttccgagttctctattctgttgctctatgtgtctgttttttggacaagtgccatgctgtttggttactgtataatcttgatgtggtcccaaaatgggaggaagtgcaatatgctccacctggagagggagatggagaatgccaaagatttctggagaggtggactaaggcagaccctagagggcttggtagggacgataatcatttctaccacacagtgttgttaaaagattcagatgcaaaatctcccataaatcatagcaggaactacacaatccataaaaagcaacctagtaagatttcagtgagtaggctactaattaatcagtatgtttcccctaagccagcaaaaaccaattctaaaacagagtgagaagaaacctactccagaaagcgagcatagaaatacaggtctagaattaaaggttcacaacatgtgcaatatctgtggtgaagcatcatcacactcttcaaattggacaaagacagctggatggaagtctctacatggtacacaggtagatttcacttaaaatagtacaaaaatcccaatatgacctttatcaagctttgttgatttattattcttgttatgctggttctattgttcatacctcccaattctgtgagctgctgtacgaaaaataaagcgtctccgtgctaaaagaaaaaagccaaagaacaaggcggcctccacacttctaccatctaaatctcctcacgtgcacctcatcaatagaacctaaattactggtgaatctcagataccatggagtttgtatacatagattttagttttccagctttaccagtcaaaagacatatgaagaagttgggatgaaaacaagcaagccaactacagtatcctcggcttctgcaacacacatttaggttttgcctttacttcaataccctttctctttcaataggtctgtccgttcaatttatgcaaattatgcaatttcaatttatggaaattagaaatggttggtctcttttctgacaccttatttttgctatgcttccttttttaactttttatttctccccatgtatagttaattatgtgtttgtgtttgagagctcggtttttaaaattaaaattttttactttttcattttattcattttttccaacctcagaagagcacattgttcttttagatctttggattactcttatatttcaaataatatgctcaaatgtctagtttttccacaatctaattactatttaagtacatttacacatttgccactctctccaccatgcactcaattttagtttttcagttacattattcctcttaaaaccttttagcatatccctatactttaatcatataattatatccgtattaactgattcatcaagtataaattgtaaagaggttggtctgccaaggaaggtatggattttgtgaagatataaaagaaaataaaagacatgtaaatactggtagaaggagacatctttattagtcatttccacatccatctccccagtttctagatttttttatattgttatcacagtctatattgtctcagtttgttacatttctattttagtcataccttcatttacttattcatatagagtcattttctcatgtgtttttattaaatgcttttacatattatcaggaacctttccattatagtttctccaggcatcctttggtgggttaaggtttgtcctcaacctgttttattgtgatgtatatatgtggctattctacttttcctttctcttaaatcttaaagaatggctttgttttttaaaagatattccactaaaatattgttaagtattgctctattttttatcatttaatataaataaaattcaaagaccggcctaataccactatattgtgatattttgcctagatttcctagtaattctaacttagacacacacagtaccatatttttgtgggacatatctggatatagaaaatactatatcacattttgaaaaagtatctgcatgtacattttcattctaatcatttacatgtatttttcaaccacaatatttatgtttgaccctttttgttggtttccaaatccactgacactttttaacctctctctttattttcctcaggatttttaagcctctttttctggtccttcattatttttaagctgtttctcttcatttgttaacatatttttattttacttttatcttctatttattctctaacatctgtcacctcagtattgatttctgtttttgctttataccgattcctttgaccctcatgtagcatttgaattctattacaaagaaatatcagatttcatttcaactttatttcaagggaaccaacttttcataattttggtagatattatgttgtatgttttctattttgctttagctttctttttacttttgatatatgatgttgcctaaaacgaaatatttaagtaaatgtatttccattcctagctacctatgtgttttaggcagatatgagttttgaaatgtatttgaaaccttttggatcctttatatatgctacatagctttcataggacaccaagcgacgcaatgttttacagccttgtcttgtatattctgtcctatccattgttacatgtctgagaccaaatttggctgtttttatcatttctcttaaacatcagaacctcatctccatcatttttctgtaaaccttgctttgaattcttcagtctctcctatctttagttatctaataacacatgcaatttaattcagactgataaaggatattgtcttaaatctttctgcctctcttttgtccttactgtgcccccagtgaccagcataggaatgggcacaaagcaggcacctgactgtggagtgaataaaccaatgcctggcaacatttagaatttataatcggcaaatccactacttaattatattgagaggattaatttaaaacaatcaacttgaaaacagttaaaatggtagctcagttcatttactgaaaacaaaggaagcattttaaacaattctcttggtcttcgtaacctttcgggactagccccctaattacctgcaagaatagaagagcccagggacctcctgagaagcccagtttcctccgtgttccttatgctttttcccttcgtggaaaaaagtgattgcacctttctttccatttcctaattctacatcatgccttgtatttagctggagactcactcagagtgggagagcctgagagaagagctggagacaagcaaggtctgcaggggattccagggcaggccggcccatgacctggccagccctgccatgacctgctttcccacccaggtaagctgcttacacttccgaggtgaaactattagaaaattaagaaaaaaaaattagacgtgtgtaaatttaggaggcacaacatttccctggagttgaagggaactatactaagttctacagaacttgagtatttgaagatgcttaaattatcattgtgctctattcagccacaaggatcttgtgctataaatttatcgtagaatttgctgttaaaacacacccacactaaagaagccaccacattactctatttgtgacttttgttgcagaaatattactatacatttatttttcatatttcagctgtgaatttttaaaatcacattcaaaggcatgaagagttaggtagtgaattgtttactaaagtgtcattttaaaagaaattcaaaagtttgttttacaagtttaaacatttcatgtatactaatcagggtcagccttaatgaagctatggtctacttagaatcgaaacctgcatattaagctattaaatgttactcaacaaagtcactgaaaatttctagtgccataatctgatgaaaacagaaaagttatttctcctcaatagattgtcaatggttatggtaaaaaattaaccagtgaaatgtgtggttccttggcacgactgcaacacaattctgggaaaatactacaagtctcaaactttccattgtgattcactgaactaaggaagcattactcagtaaattattatgaaaatttagtaaaaagttaggtgaaactaggtcctgttatcacattaatttaaaatatcaaatcgattaaaggtttacatgtggaaaataaaaatataaaacaagacacatgaatgggtaaagatttagctaaacggtgagcaaaggcaatgaagaaaacatggaaagtaaaattagtatttgaaaactgaaaacaatctctgaataaaacaaattttttctaattaggaaatttatggttcacatgacgaatcaaaggctgaggatcggtaatgtgtaagattctcttgcatattcataagacagacatggcaatttttaaaatgacacaaacatgttagtaaacaatttgtggaagacttgtacatacaaaataagacaatgacaaaaagcacaaaaatgtccattaatttgttgaataacagagaggcaaaaaaatgtgtgattatcagtgttgctgtgagtcagtgaaaacaccagtgcggccttttgtggtatgccggggtagatcactgacgggtacaacccgagtatatgaacatgaaagggacactgtttaataaaaatgtaataaccgatacaataaaggaattccttacacagatattcattatagtattgttttagattagtaaaaaattggaagaaatctacattggaaataagaaaactcagattctgttattaaggtaaattgtgaagttatattcaaaacaatatttttaaaaagtaaacactgaaaatatgtacacaagaatatttatgcagatgtagagctatatacagcatgattctaatctatagtattttaatatatctatgtatctatatattaaaaatatcattttctcccacaaaaaataagtatgtgagatggatatgttaattatcatgacatggtcattccacaatgtgtacatgtattgaaatatctcactgtacccaaatatatatacaattgtcaattaaaaacaattttcaaaatcctattttgaaaatttttattctgacttgatcattatacaatgtatatatgtgtcaaaacatcaccccataccccataaaaatatacaattgttatgagtcgattaaaaacaaaataaactaaaatttttacaaagaaaaaattttatagtaaatgtggtaggatttattttatacctttatttctccttttagttccatctatgtcttaaattatgtatagcactcacagatgtatttatagagtgaaaaagatgttttaaaaagataatatagttttaatcataagaaattattgacatgaattttttttgtcaccacgcagggccccctggtttgggcccaaacacagctgccccactctgggctgaccacacctattggtagcagctctgcatttctctgggatggggcccaagaaacatgtgaaaggccctcttccacaacactgccaggaccctgctcacactgcctccaggctgaggggaacataaagcctgagtcaccccagaggtgtggcctgtagcccaggagtaccaagctgagatctacagccagcactaaaggaggaagaggagcccacactttcagagcactgagagggagcaagcctgcaattgtgagaaaataggcccttgttcagccccacggctcctctatctaccggccattatgcttaagcaccatctactggatcacagcccaaacttcgacaccaaaaatactctaatatacctccccatgaaaccaaggccaagaactcagctatgagtaaagaccctgcacaaagccttgggccctctgaaaacatccagaagtcaactgactgtactcaagttacaccacagtgaaggggacatgagcccacacagatgagaaggaaccagtgcaagaactctggcaactcaaaaagccagagcatcttttctccaaacaaatgcactagctcccccaactagggttcttaagtagtctaaaatggttgaaatgacagaaataggattcagaatatagataggaatgaagaccatcaagattcgggagagagttgaaacccaatccaaagaatctaaggattacaataaaataatacaggagtgatcgatgaaatggccattataagaaccaaactgatctgtgagagctggaaaacacactacaagaatttcttaatacagttacaaatattaatagcagataggactaagctgaagaaaatctcagagcttgaagatgtactctaaactcagaaaaaattaaaaattaaaaagagtgaagaaaacatctgagaaatatggaattatgtaaagagaccaaatctatgatttatatggtatctctgaaacagagcgggagaagacaagcaatttaggagacacatttcaggaaattgtccatgaaaatttccccgatgttgttagagaggccaatattcaaattgagagcactgagagagaacacatttggtctcccctgtgagccctttgtcctcttgctcatcaccaggaagggcccccctggtttaggcccatgacacagctgtaacactctggatcaatcacacctattggtagcagctctgcatttctccatattcatgtggggtaaagtgtggttggtcggaggaaggtagacactctggcaactcaaaaagccagagttcttgcactggtttgttctcatctgtgtgggctcatatccctttaactgtggtgtaatttgagtacaattaacttttttctgcaagacacaacacaagaagtccatcactaagatacatagtcatcagattctcgaagatggaaaacaagaaaaatgttaaaggcagctagagaaatggggcaggtcacctacaaaggaaaccccataagctaacagcagatcctttagcagaaactctacaaaccagaagaggttgggggcctatgttcagcattcctaaagaaaagaattttcaaccacgtatttcatatccagccaaaggaagcttcataagcaaaggaaaaataagattcttttcagacaatgctaagggagttccttacaaccagacctgccttacaagaggtcctgaaaggagtgttaaatgtggaaagaaaagaccattaccagtcactaccaaaacacacttaaatacatagaccattgacactataaagcaaccacacaaacaagcctgcaaacaaacaaaaaaacacctaggaataggatgacaggatcaaatctacacatatcaatgttaatcttgaatgtaaacaagctaactgcctcaaagggcacagagtgggaagctggataaagaagattcaaaggtatgctgtcatcaaaagacccatttaacatgcaatgacaccaataggctcaaagtaaagggatggaaaaaaatctaccaagcaaatggaaacaaagaagcaagggtttcgattctagtttcaggcaaaacagacttcaaaccagcaaaggtcacaaaagacaaagatggccataatataatgctacaggtttccattcaacaagatctaactatcctagctatctatgcatacaacacagaagcacccaggttcatgaagcaagttcttaaagacctacaaagatactcagactcccatacaataataatgggagatttcagcatcccactgacagtattgaggcaaaaagctaacaaagagacttgagacctaaactcaacacttggccaaatggacctaatagacatcttcagaactctgaaccccaaaacagaatatacattcttctcacgtgtacacagcatatactccaaaattgaccaatcggacacaaaacaatcctcagcaacttaattataccaaccatattcttggaccacagtgcaataaatagagatcaatactaagaaaatcactcaaaacaaagttatatgaaaattaaatatgctaatggtgacctttttgtagacaacaaaattaaggcagaaatcaagaaattatttgaaactaatgagaacaaaggtaaaatataccagaatctctaggatgtagctaaagaagtgttgaggagtctgcaacactaaatatccacatgaaaaagtcagaaagacctaaaattaacaacctaacatcacacacttagaactagagaaacaaaagcaaaccaactccaaaactagcaaagaactaatcaaaatcagagcttaatgggaggaaattgagatgtgaaaaaccatacgaaagatcaacgaatccaggagttggtatttgaaaaacataaagagacaaatagaccactagatagactaagaaaaaagagaagctacaaataagtacaatcaggattgtcaaagagttcattaccagcaacctgacagaaacaccaaccaaagaaaaccctcagactactatgaacagctttatgctagagaatctagaagaaatcaatgaattcctggacacatacaacctctcaacattgaatcaggatgaaacagaatccctgaacagaccattaaaaagttctgaaattaaattcacaatagaaagcctgccaactacaaaaagtccaggaccagacagattcataactaaattctgcaagaggtacaaagaagagctcatatcattcctacagaaagtattccaaataattgaggagagacccctccctaacttattctataaggccagcatcatcctgatctcaaaacctggcagagacacacacacaaaaagaaaaacttcaggccagtatctttgattaacagatgcaaaaatcttcaacaaaatacaaatagaatctaacagcacatcaaaaagtttatccaccgtgaccaaagtaggattcatccctgggatgcaaggttggttcaacatcacatcacatagaattaaaaacaaaaaccaaatgattatctcaatgattcagaaaaggcttttgataaattttaactcccatgttaaaaactctcaattaaactagtcattgaagaaatatacctcaaaataacaaatgccttctatgaaaactccacagtgatcatactgaatgtgcaaaagctggaagcatttcccttaaaaaccagcacaagaaaaggatgccctctctcaccactcctattcaacatagtattggaagttctggccagagcaatcagcaagagaaggaaataaaagacatccaaataggaagaaaaaaacctcaaactatccctgcttgcagacaacatgatactatatctagtaaaccacatggtctctgtcccaaagctccttgatctgataaacaacttcagcaaagtttcaggatataaaatcaaggtacaaaactcagtagccttcctatgcactaacattcatgctgagagccaaatcaagaatgcaatctccttcataatagccacgaaaataaaatatctaggaatacagctaactggaggtgaaagatctctacaatgaaagttacaaaacactgctcaaagaaatgagagatgaaacaaatggaaaagcattacatgctcacgaataggaagaatcaataccatgaaaatggtcatcctgcccaaggcaatttccagattcagtgctattcacatataaaactacctatggaattcttcacagaattagaaaaaaatattttaaaattcacatggaaccaaaaaagagcccaaatagccaaggcaattctaagcaaaagaacaaagctggaggcatcacactacccaactttaaatcatgcaacagagctacagtaaccaaaacagcacagtactggtacaaaaacagatatatagaccaatgggacaaagtagagagcccagaaataatgacacacacctaaaaccatctgatcttcaacaaggtgaacaaaaacaagcaatagggaaagaactccgtgttcagtaaatgttgctaaaataactgtatagccgtaatgcaaaagattgaaactggaccccttccttatactacatagaaaagtcaactcaagattgattaaacccttaactgtaaaacctaaaaccataaaacatctggaaaataacctaagaaatatcattctagacataggacccagaaaagattttacggtgaagatggcaatagcaaggtcaagcaaggtcaacaaaagtgaaaactgacaaatgggatctaattagactaaacagcttttgcacagtgggcaaaggatattaacagatacttttccaaaaatgacttacatgcaggcaacaaggatataaaaaatgctcaatatcactaaccattagagaagtccaaatgaaaaccacaatgagataccatctcacacctgtcagtgtgtctattactaaaaagtaaaaaaataacagatactggttaggttgcagagaatagggaatgcttatacactcctgttgggaatgtaaattagttcagccattgtgaaagtagtttggcaatttctgaaagaacgtagaattaccttttgacccaaaggaatataaatcattctaccatgaagtcacacacacacacatatgttcttcacagcatcgttcataatagccaagaaatggaatcaacctaaatgcacatcaatggtagactgaatcaagaaaatactgtacatatacatcatggaatacatgcagccagaaaaaacaagatcttgttttttgtggcaatgttgatggagctagaggccactatactaagtaaactaacacaaacagaaaaccaaataccacatattttcacttatgagtgggagctaaacagagtacctatggacacaaagaataacagacccccccaccgggcctacttgagggtgtagggaggaaagtgaggactgaaaacctacctatcaggaactatgcttatcacttgggtggtgaaataatcagtgacatgcaacttacctatataacaaacctgcacatgtacccctcaacctgaaataaaagttggaaaaaaaactttaaaaaagagagaacgtctcaaggacaaatgctgttagaataaaactaccaatcccgaattgtaaacccagctatactatcattcaaaagtaagggtagttagacaggagaaataagtttagatctattgtataacatgatgattacagtttatatctacgtattatatatttattttcaaattgctagattttaaatactccaccactcaaaaattataggatgtgaagtaattgatatgttgattagcttgattttgtctttccaaaatgtgtatatatgtatatacatattaaaacattgggttgtacaccatatatacaattgtcaattaaaatataaacttaaaaatttgaaagaaaatggtaataaaaaattaaaaggattaaattaacaaaagatattttcaggccttttttgaaacataagtgtttaccactcagtgaagggactcttatgtttaaagcataaatacagaagaatcaagatgttgggagaaaaaacagcaacaaagttttggaagctggaaagccaaaggaaactgtttttgactcaaaaatctcaaagcagaacactgagctggtgagtggagaagttcggaagcaagttgattcctgctggaagaactcctaatcaggtctgtctaaatattacaggtaacattgaaatgggaggcttggctaaaagtttgtataaaaactgttatacacgcactttagttagacaacccttcctccccgacctgacgcgacactaacttgggaggtggtggtgtacccaaagggctctgggattggaaaacagacattgcgtgggtgtaagtgggaagtctgcaccctacattgtgaagcacaccagcacgtttccccaacgtgggttctcagaatgctggcagcccccagaaagatttgcagaggaagcagaccataccaaagaaaatacctaggaatactgacatttgaggtttccaaaataagtcatttacatcatagtttagtgactcctactcgttaaggcttgtccttatccagagactaacattaggagagagacagggattacaaaacttgaggaaagcttctaaaataaaaggcagaaatcacacaaatcagtgaaaataagaagaaatacagtatgcagtaattagagaaactctttctataaaagataactgactaatctgctatgacagataagaacatacaaacagatattaaactagaacagggtgttttaaacagagcattggagaaatttttaagagttcttgaacatttagattatggcagtgtagactgtaaagtaggacaagacagatgcaaaagaaggtagaagaagagatccagtttgtgagtcaggaggcaaatcaagtaataaaaattccagaggaaaagaatgttttagatggaaggaaagcacatatttcagtcatgtttcagagcaaaaattctggaattgaaagacacgtttcaagattaaaaggttcatcaattgcccaacataattgttaaaaagagcccttatgaagacattatgaatgtttaacacgactgccaaaggagagcctgaagcctccaggggacgacaacacaactaaaattgagagcatggaactcccaggagaaatactgaatgttagaagacaatggaggagggacatcctcatattcatgagggaaagcttttttcaacctacacattgacacctggccagatctactgtcaaagtgggaggataaaaaaagtcattttcaaacatgcaaggcctttaaaaaatttcctcccacgtactttgtttataaacctgttgaaagacatgctccacaatggggaggttttaaagtagaagacgtggtacacagacaatcaagaatccagagggtcatggggaagaggcagcatctcaggaggagccccgtgcagcgcagcccatctctggggcaagcagcctggatggaagcggcagagcaggggctgcagaagagggagggctgtgaagacggcaccgagaattcctgagggagtcacagtttcaacaggatatttatcagaaggagattctatatacatatatatatatacacacacacatacacatatatatagagattagtcagttttctttcatgtatacatatatatgtatatatacacacacacccatatatatgtatatacaaatacatatatctcctagctactggggaggctgaggtgggaggattgctagagaccaggagctcaatctctttcttgacccagctggtcaagaatgattaccaaccctcaaaacctgtcctgtccccactcagtcaccaaagtgattgtgactctgacttctgacatggtattctatcagtgtcaatcttccatctctgctctttagacctatctgcctctcagagcatgctcacaggagactgaaccacacaacctgcttgtgccccttagagtcctcttgtagcccagcttgccctctgcacttgctcttctgcatatcactgatggcagctagttttgggaccttgttcaccaagtcaggttttgagaggtgaagtcaaattttgttcataactactctaggctcttcattaatggctgggactctggaaataagctcattctgatggaaaggctaataaggaatctgttttctttttaaaaattcttttaatcttcccatttttgtgtcttttctctttactggtatttgaaatgcacatctttgtaaccaggtcacaagaatgattttgcttggattgtttggtggcctcagacatagggttcagaagcatctttcaatgtcattatctttttatcagatcttgaattgcttatttgttgtttgtgtatgtttatgtccatgggcactaatatgggttcttctcactacaaaaatcagggtccccttcctaaaattccggctaaatactaaagggttttaaaccaaaagtaaaattctaagcctccctcaaccatctgaatagggccctcgtctcagcaaaggcattccaaagttaacctgataaactagttcaggccatgataggaaggaagagcttgacatgcctcaggataccctccctcccttttggaattactgatagaacagattctttaagacttaagtctaattaaaaaacatttacaatcttctctctgaagcctgcttgttggaggcctcatctacaagatcaagtcttggtctccacaaacccttaccataaccagacatttctttctactgataaacaactctttcagctaattgccaatcagaaaatctttgaatctgcctctgacttagaaactcctgcttccaattgttgtgtgtttccaggtcaaaccactgtacatcttatacatgttgactgatgtcttatgtctccctaaaatgcgtaacaccaagttgtccggccacctcagacccgtgtttctcaggatcttctgagggtggttccatgggccattggtcactcatttggctcagaataaatcttaaaatacagggtttgacttttcatcgacagggtatacaatttatataattttcaatgaatagtaaaaattaaactgtagtatttaggaatatttatccagtcatgcaagaagaaatccagggaataattactatgaaattcatttggcaaaataactgaccaatattcttcgctgtcaaggcccaactaaagaaatgttagaaacttaactgaaatgagtgagaattgctcagtcaagtttcattaagccaatattagagtatgtctagaaaaataagccacagacacacccatggccatttttccaaagaggtttttagaacactcagtacgtatatattttcttaaggtgggggaaggcatataggaagacgggcgggttggtggtaaggtcaatggttacgtttctgtgagacttcagttagtgcccagtaaatgtacattttacacaggataaggtgaatgtctgaagagatagaaggagccaaggaagagtcaattatgcagaagtccctgggtaggtggaggaatgatttgtctcatccggtctttcttctgctcctggaaagaagcttgtcatcaacattatcagtgtgcaattgagcagacagaagagttcaagaccagcctggccaatatggtgaaaccctgtctctactaaaaatacaaaaaattagccaggcatggtggtgggtgcctgtaatcccagctacttgagaggctgtggcaggagaatcacttgaacccaggaggggaggttacactgagctgagatcatgccattgcactccagcgtgggcagcaagagcaaaactgtttcaaaataatgtcagcattaagagaaattgagtgacggccacattggaagctcattgtgctaattttgcacatttttgcatgtctaatagttcaaatgaaagttagagacatttagaataatgcctgtttttgccctggggcatgtgcggtgatcaaacaagagcgccctggagtgctggttatgttccgtttcttgatggggtgcggggttatttcatgaatggtttcacaactgttttcttgagatgattaataatgagttttgcatggcatttctagtgttatatttcatagtataagaagagattaacgctgatttataatgtgattttcttagaagccctgctgttgcctgcgtcattaagtggtgattcaattcactccctaaaattacaaagtggctggaattaaatatccccaagcaaagacttctttcctctatgttgtagcaaattcagtaacttttcaagttttaccaaataaagtgagggatattaactataatatttaaagctattaaattctatctataattacagaaatatatatggagaaacaaactttttggcaaattatttggcaataaataatcatagattcaaggtttttatacaattcattgtattttttccaattgattctggagggattacagagtaaaaataactgctaaaatgcagaaaatgtttaataacaaaaatgatgtcaccatcagtccaaaggtaccgatattattcatttttttttttttattctcctaatgatacatgcagttttaaagaatagagaacacatggtgttgttttaggataatgtcatattactaactggccacaaggtgtcaggaggaggatgtcatggtgtcccatagtaacaatcacttgggacttcatattcatgtatagatttcttcttcctgtacagatagatcagcaagccaagagaaagtggggagatatataaccatcttagacgcaatcgcaaatgtctcagtgcagtacctgaggtagaagctattcaacgaatcaaggaactcctgatgagagctttgcccagggaacccacagaagacggcttggctagatcactcaggcagagcccccatggcctgaaggagcaacagttgtaggcttagaaaatatctgctctaagaagcctcttcctcattcttcaactatgatagactctgagcaagatagtaaactatggcacagagaggttaggtaacatgctcagggcacacagcccagaaagaaataggctaatattcagactccagggggttcaagctccaagcatatggccttatcacccttaaattgcctttgaaattggcagatggggtggaaataattaaagaacagttaaatattcatggggaaaaaaccttataaaaagctgttcaacatctgaacaatctgttgctgggcatatatgctggtatcacacagtattttagtgaaatctgtgtgcccatctcctcttggtgccaactacaactaggacactcagagcagggacattttcccacgctaaatgggaacccatcaccagagaagccaccaccaaagccaagattacagagagaatgttttaggagtagggtggaatttaacttctaaacgtaaataattaacattttgaaatgaagtgacagtgtcaccttataatgcaaaatcatgccatattatacaagaaactccacaccatgaagaattctgcctatacaacttttaattgcccaaagagacaaatttattgaaataaacagctactgaacatctattacatactgcaaattatatgccttggaaaagcataaatatgacacactttattcacaaaggaataagtttgtagtagtaacagcagttgctgctgttattttgtccttgtttttaacataattctagttaacatattgagtgcctactattttctggccaccatcccgaacacacatcatgaatcgtctgacaaatgtgctgtgctaaattcataaattcaatgcaaaggagggggagtccgaaggttgtcctacaacccagatgtctctactagcttattaacttacctcttctccaagatgattctcttctcctctcaaacttttgacgggaccaccctgatctttactcatagacgctctcattgattctaactgcaccgagaagatacaaaccatcggaagggatcttagttataacacacgctctgcctgacctcctgctattgtcactgagttggccatgctcttacaaaagttcaaactctccacttctaaactggtttctgtgctttcggccactctcaaaggccatctttctgaaactttcctccatttctcatatatcgattttctttttgtactgaattattcctttgaacttcatactcaatatcacatgacagcaccattaacatcaaacacattggtatcacgtttttctagttatactccatttcctttacaaaaaaatctaaaaattcatactcaacttaccttatccacttcctcccccttgattttaccctgaatcatctctaagcatatctccattaaaaatggtcactaaggttacaagtaacctttcatgttgctaaatacagtaaccaaatctcacttatttcaaccatagactgcacttgttgcagttgcttttactttctttaaacactttgtcttagatttcttctaacctcataaaaccctatctttctaatttttcatgtgacgccagctgcctcagatctcagtctcaagctttctcttaagaaaactctcaaaaaacctgtttttaaatgctcttcgtactctgattattaaatgtatgctttatgttcagaactctaatctgaagtacaattgactttacatatagcttcaatatctttctgtatttatgtatttatcttgagacaaggcctctctgccagtcaggctggagcacagtggtgccatcacggctcactgcagcctcaacttctcagcctcccgtgatcctcccacctcagcctcccaagtagctgggactacaggcatgtgccaccacatccaactgatatttgtgtttttggtagatggggttttgctatgttggcaggctggtctcaaactcctgagctcaagcaatccaccctccttggtctccactaaagtgctgggagtacaggtatgagctactgcacccggcctagcttaaatacctaatagatatttccaaattatcttaagtgaattcttgacttctgctaccgacaagttttccaaatatcaatattccatttttttattcacttgggcccaaaccaataagttatccttcactctacacctgttgctaacacacgccaaatccatgagccaaatcctttgtgtccacaccctacacaagccatccttgtttctcatctctgaaacctcaattgtcttcctgtatccatgtttgccctttgttctattttcctacactgtaggcatagtgatgctttaaaaacgtgtctgttatcatgtaacacccgcatggaaaactccagggacttcccaccccactcagtcagtctcaaagtgccttaagtgttgctgttgaatcacagaacttggaaaagggaagtttctggccatggatgttaacgaacctggtatcctgttaatacatcctcaaggaaagtggcagtcatgttctttgatgctaagtgttagagtctattccctgtgagtagctgtgtcatgctgaacctccacccattcatactcagttctgttcaattcaccaccatttattgtggcctagtatttgatagctgctgtctgtactcaagagggtcagagattcaacgataatattagagcttatagttacttggggttaatactaaaataaaaaacacgactaaagtgtgtgcttttatcttctttgccacttgtgtattggcattcttttactctattgctgctaatcacagaatttgactgtaaacatttgatagcttttgcaggtttctttcattgtgttgtttaaacatgaacaaatgttgtgaaggagatctagttcagagtgaaaggttgctgtgaactctaatatttggggtttttcttccctaaataaaaagactagataaattatttaacttcataataaaccatttttgatacttcactgaaagatctctgcataacagtaaaacatctttcccttgctcccgaggagcaagaatccagacagggtgaatcatcttaactgccagtagtaagtgtaggttgatagctgagcagatcatctccagggaaacagggcaaatggaggaagtccttaggaagccttatcctctgggcagtgactctctaagcatcacttgttgctactttctgagcagatgagcaacatgcaaatacctttttaaatgcccctatgacgtccttgtttctgaggctgtagatgagaggattaagcatgggcgtgacaatggtatagaaggctgacactactttgtcctgctcgggggtgtggaaggactggggcagcacgtatgtgtagaaggcagccccatagaagatgctaactacagtcaagtgggaggaacaagtggtgaaggcctttttgcgaccttcagcagagggcatgcggtggatggttaacaagatgagggagtaggaagtggagatgatagagatggggatgagcaacatgaggacacagcagatgtacatcagagtttcatacaaggacgtgtctgcacaggccagtttcagaactgctgggatctcacagaaaaaatggttgatacttcgggagccacagtaagggacattcatggtgatgggagtgagcagaaagccatcgagggagcccccaaaccaggcaccagcagccagcaaaagacacttcttgcggttcatcaggactgggtatctcagagggttacagacagccacgtagcagtcataggccatgaggcccaggaggaagaactcagaaccaatcatggtcaggtagaggaagatctggatgccacaggccacaaaggaaatgatcttctctttagaaaccatgtctgccaggagttttgggacagtggtacagatgaaaagggtgtccatgatggacagctgactgagcagaaagtacatgggggtgtggaggcgagagtccacctgaatcaagaatatcatgaccaaatttgcagtcacggcccccaagaaaacagcaaggatcactgtaaatacaatcccggcagcctcactgttcaccagaagccccaggagggtgaagtcagaggatgatgtgttcgtcattgatatggcccacgagcgtcccagggcaacgggaagacacaaggaccaggaaggaggcaagagaacacggtcaagatgggaaaggtctgcagtagaggtgacacttctgagggtaccgtcaggatgaagcttccaggctagaggctagagaagaacaggcagaccaacatgcacatcatgaagcaaaaaccatggctgcatttccctgtcagagaacagctccttctatattgcgtctatggttcatcatgctgctggaggttatggtaactgcgtgatacaattgctgtatgctacaccaagaatggggttttaaccatatctgttctgtccatgctgcatttcttgtatccagaaagttatccagcccatagtagggttaagtaaatactagttggaaaaaagggtgattcattgaccaaatggataaaggggagtgaagtaaatcactgaagaaatgaagggttaggataactattagggaacgttttattcacgaagccccatgtttctgttctatttctttttaattatttgtataagtttaaggacgacaagtgcagtgtcatgacatggatgtatcgcatagtggagtcttgtcttttagggtaaccgtaagtcaaatagcgtaggttgtgctcacattactaatttctcacccctcgctccgctttcaccccctactcttccaagccttcgatgcctattattccactgtttatgtctaaagttgggactcctcactgttctttgtgctgttttgctaacctttttgcagatctttcttcagataaattagaaggtaaaaaaaactatttgcaaaaagctcccagaattaagtttttaaaaagcagtttatgacactaagctgactccctgcattgctctccattgctactgtaggtttgggaaatgggcagggaaattaaaggaaaatgttggtaggttgaagctatgtcagcagcagacacacaggagcagggttcaccaagctacacgtctgccagcacttaccagaactgaggccagagccaaactcaggcttagaaagctacggagcagatacatggaaatgtgacagcaacaggccaccgtttaagaaggaattttatctttaacataccaggtggaagatagatttaactgttagacaagagaaagaaccatacatgtagtaagaatcgcccccctctccccgccagcacctcctccccggcatggtaggcctcagtggcttgagtctcaaacatttgtgtaaaaatgaaagtccgatcaacgggggagcccggatgctgcagggtttccccccattcacatgttgctagacacaccttggctccactatctagtgttgccagatttagcaaagatacaggattctcagctatgtttgactttcagataatcaaaaaatgttttagtgcaagttcataatgttcttaacaccaaaaaaaagggttcactgtacatctgaaattcaaatttagctggttgtcctttaccatgctgaagtcatatctggtttcacaaaggtaccagaattgttatgaccttgaaaagtgaccagtagaatcagtacaaatagagtctaaacaaaaaagttatttactaacatcaaaattaaattggcttactcccaatttccctctgattgatatattcatattactgtgaaaggggctaaggactgtggcctcctctgtcaggcctcccagaaatactccgtggtcaaaactctacttcagtgagtcttagcctcctgatccactcctgatcgtttcaattctattccatttcccaaggatagtgaacacaaatattgcctaaaaatatattctgctaattcaaagtccaaaaatataaaagaaacattctatattagactccaaaaacttcctaatagaattaacccacactaaggagaagagagcacatctctttgtcatattaaacaaattcaaacattttatccaaaatgtataaaacagtaaaaacaggccaggtgtggtggttcatgcctgtaaccccagcacttagggaggccagggcggaaggatcacttgaagccaggagtttgagatgagcctgggtaacagagctcgtctttataaaaaactagccaggcgtggtggtgcacgtcagtcgtcccagctactcaggaggtcgagttgggagaattgcttgaggctaggagtttgaggttacagagagctatgattgtgccactgcactccagcctgggtgacagagcaagaccctgtttctaaaaaagaaatgaataagtaaaacttatttattaacaattaaaaacctataatatttctcatgtccatagctagtaggtgcctggcttaatccatcatgacacattttaccctggttgttccacgaactttcccacgatctccctgctgtctcatgaatccctccaagtctagtctcagcacaaccatcaaagtcacatcgggacccgtgcatcccgccacgccactttctgcttgaaaccctgcagttgtgctttacatcatacattaaggcccatcacgttctgaacattttgtcttctgaaatgatctcccgccgactccagtctgtctgtccctgggctgcagcgacggtggcttccttgtcctctgtccccactttgcaagagccctgagcccaggccattgcctctgctgctccccttgcctggggctcctcctccaaccgtgcaaggccatccatcccctcatgtacttcagggctttgctcaaaagccacctgctcagaggtcctatgactatttttcttcacttttcttaacaccgtctgacactaccttgtgttttgtgtctcttcaagctagaaagtaagcttcatgtgaataaggatttgtgcctattttgttaactgtactctcaccatctaaagatacgactggcacattgtaaatctttgaataaatcatttttaaacacattcagctagcaaaaatgcaaattattttatgctttttaaggaatacctctagaattccttcaaaacacctcctgattttatataatgtgctgaagagaaataattttttttaatgctaggcacttgtgtttatcttcaatgcaaaatagacaaaaaaatgggatccaccaatatttgatcaaaaaaaacttcattctaggaaaaataaataacaagtttctaagatcagacagcaatacaacttctaaatcattaaggtttatatacagtacaaatttgagacaattacgctctggtttaaaatacttatagagtaattaagatgtcagcataattcacaaaaaaaggagggacttgccacttcttctgtcttctgaatctgtccttgctctgacagctcttcaactcaggtaccaattaataggttgaagataactttagcttcaagtgttattatacacccagagattgtactgcagatgttaatctagttagaattcaccttatgttaaacagataaaattgtgtatgatttattgcaaaatgtcatctgccttctatgatcagaattgtcttcaataatgccatagggcttattaatttgctacttaaattgaacgacactgtaatagacttagtgttaaatataaccacatgtgggcagaatcatcttccacctccagcaaaggtcctcatgtgctaatgtctggaaccgatgaatatgctctcttaagtggcaaaaaagactttgtgggtatgattaagaactctgagatgaggagattcttctgaattatgctgttggactcaattgcaaatgccaaggccttacatgggagagaggaggaaggagagtcagagacgtgatatgaaaacaggtcggagggactcagtcggtctccgggtttgacgatagaggggaccccaagccaaggaatgtagatggtctctagaaactggagagggctaagaaatagattatctcctaaaacctcatagaaaagtaggtagccttcccaacatcgtgatttcagtccagtgagaccggtttccaacttctgacctccaggctgtgatattatgaactttgtggtcatttggtaccacagccatagggagcttctatgctgataaatgattttcttacttagcttttaaacaaaactgagacatgttgcaataatgaattggccagcacttgtgtagtgcttcttgctgggtctcaggcaccgtggacgtgtgccaacgtttccacgtgctcttcacagcacctcgacgggtcgatcactaattatcaccatctcacagctggtaaaactgaggctcagagtcaggtgggaggagctggatccaggctcaaggactcaacttttgtttttcatgctctctgccactacccttaacttctccccaaagataatatccctttgagcatcacttccgtttacaaccagccaaagagaagttaaatgaatgcagggtaaaaggccataaacacacccaaggaaaagttgaatttctgatcacaagttgtcaacaaagcaataaagtgacaacatgaagttaataattttccagaaacacaaaattctccctaactcttgggcaattctcagtcattacacacctgcctgcaggtgtctggctttatactgaggtacataaaaaaaatctcatcaaatgtaccccaagaaaggtcttacaaatgccactcacacacgtcactgttgtgcaattgcagagggcaatgactcatctcccagcagacatcataaagccccattcaataggcatgtttcctgcacagcatcaccgctgtcaacatgaagccctgtacgtactattccctgttggggatctgagatttgaagatctctgtaatgtggcagagttcacttaaggagaaaattccaatgtttctagcataaagaaaatacaaatatatatttaaggtaatggatatctcaattacattgatctttacaaatcatatgaatgtgttatcacatgtaccctaagaaaaagaaaaacagaatgacccttgaagaatcttaaaattacatgaaaaacaaattcatttcaaaagaaaaattacagaagtgtgaactgagtttaaatccttgtggaatcaattgaaatggtactagtgatcctatcaatgatttatgaaacaatgagttaaattatgataatttttttcaacataattgtcctcgtatcctatattttcctaggtactgaagacctctaatggacagatttttttaaaagataatttgaagggccaactgtgtagtcagactttatattcttatggtgatgtttacttttgttgtaacacactagatcactttcttagaagttccctaaagttgggggtttgggggaactaagttacaggagagtctccctgctgtggattggggacagttgagggaccatttctgaaatgattattcacaacttgagccagatcagattatctagacttcgttattgaactaaacatctttggaaaattaacgctgtttttggcctcttgccaatcaagcggtcttttcaggcctctcttaggtggagtcatgaaaacaactcatccctccctcttaatacatgtctatcactgcacagttagggtcacattcttcttactcttgcaaggcgatgaaatgcaatgacatgcacatctactcagctgggccttggattgccagaggcagagggcttgaacttaagtttattcttacctagagcatgatcccacgaagcttccttaataggatagcaatgtagaagggccacagtgcagaaatagagtttcagtcaatcttattcaacttgaacttctacatgagagctgggttgtatcaacatcgaggataaaggggggaatctcaaactgctggtgggaattacaatgggttttctgtcttgttttctggtttgagagcgtgcactgagtcaatgccaggagtttaaaaaatacgtacaagcttccgctcctagggaagtgtagtatggaaataatcagatgagtgggcaatttattaaaaaagtccattccggtgttatttgcaataagaaagtggaagtaacctaagcgtctgctaactggacatgtactaaataatttaggttttagtacataatagaattctaagtgaccactggaatgtgaggtgatctatgttcatcttcatcctatagcaggttcattgtattcttaagtgaaaaggtggcatattttcaacctatataatcatctccttacaactgtattctctatctttgaaatgaaatcccttaatacatacacagcatgtattataatcttgttcttagaaataatcaaaaaaggtaaagatttttacaatctttcaaattacacaaagccattatttgcaagcatccctgccttgggccaaaattatattatcctttctccctttcaagtagtttccccagtttatacagggagacagaaaagcagttctcttcattaaaacttcagctattcagaagctgaggcccaaagatatggttttaactatgttcaaacatgttttctgattttaatttttccaagtttatagaatacttcattaacatcactggtcatttcaattaaacactttggaaatccagggaaagaacaattttgacaacatcaactgacatatgtaatcctaaactttgcatttaaattttcagtcatgaaagagttttctgcttccacccttgagaaatgcccctaatgggacttacctcctgtttgcttcaaagaaggactatatgaagaatctagcaaaagccaatgactttttcacataagctccaattttaaaatagttaatagaaatcacttatcagtgaagctggaaataatttaagtagttttttggtgtttttttttttgcttctagcatcacccttgacatgcagttctatgtgagcctataaaagtctaactttgttaatcttcagtttccacgtcgtctcttcaaacccgagatgccaaggaaactttcttttaaagatttttagaaggtactaagccttctaaagtgaaagttttcattcgtttattacactagtatttattaagggcaaattctatgttaggaaaagttttaagtgcttgcgatgcctaacaattcttgtttttaggtatgtgatgatttaacaaaaccaaataagcttaaagtgctcataaaaaatacaatgtgaaacaaccagagttgaagctacaggtatttatttaccattttatattcttagctagttgtataaaccaaaggaatgtagtcaaagcaaaccaagtattttcctggcctttattacctgggatttagaaggaagcacacagtgaaatgctgctaagtgtgtgacatggtcacgggagtcacccaggtttaagaaatccatcctcagtacaatcccagctgaaaaagaagcttaaaaatgcatctggtttttatcatttgtgtgtgaatcagcctgttgttttaactaaataacctatcgatgccataaagttgtctatgaatacaattgctttatgtatggaacttctttgtagagtcaggacctgacgtttcagtcattttgttttcacagaattgtcagaattcttagcagaacttcacttcatttaaagtcagttgtccaacttgacagggatgttctgtcactttttcagatttttaatttttgtggatacagaggtctgcgtttttcctttatgctaaataattatctaattatcttcagtttctctgatcattcctttttgcctgatatcttcctgagcattgaataaagcagttaataaggtatgtaataagtagactttatgctttcttctattacaattttatattgcatatagatgtttattgtataaaacaagtctgtagaagcaagttaattttatatccatatcccttacctgcagaaagaccccacagggaatctgattacccctcaatgtgggtcatcaggtccttggctagaccagcctaactagcatccaacagcaaatgaacatggcttttatcagcatgttgctctgaagggacctttgtccccaggtcattattagggttaacaagctggcagatacacattgtgccatgtgcttctcccctttgttttgtttttgagacagtcttgctctgttgccaaggctggagtgcagtggcacaatcttgactcactgtaacctccactctgagttcaagcgattctcctgcctcacctaccaagtagctgggattacaggcatgtgccaccacgcccagttaattttttgtatttttagtagagacagggtttcgccatgttggccaggctggtctcgaactcctggcctcaagtgatccaactgcctcggcctcccaaagtgctgagattacaggcgtgagccaccatgcccagccacttctctcatttgtaaattgtttatcagtatcatggcttggcacaaaacaccagaccagaggttagaagacgtggttctgaagccccatctgcctcttgctggaatggggcaataatttgctgtgaacatcagcttcttcatctcccatggggctaattctttctctaaatactttataagaatttgtgaagatcagaatcaaaatcaggtaatgtagttaaatgttttcaaaactagggacagtcttctattttttcctcattacctggattagtgcatgccatgtttcaggtatacaactgataatttagtaacttaaatatgatgtgtattactcaatattaaaatttatatattattttaataaagaagcaaatctggtgaccacaaattaccttatgtaagaatttggtgagatgactggggaaaaatccttggtcactcccttttacagtgggactagttttatgtgtgaagggagtggatacacaccatgtgtaaaatgagattaaaatttttttttaagttgtattaaagtagagcctaacagaaaagcacacacatcaacagtggaaagattgataaatcaccaggaaaagaacacgttgatgtaaccaccatgaaatttgttgaatagactcaaacattgaataagtcacctccttccatgccccgatcactaatgtccatgatatccctagaaacttgtcaaaatgcatttcgcttattgcttcaggtatactcttgaaatgtctgtcaatgttagagttaaatattctagttaaatatgcaaagaattaatcttggaaacataagaataaaagtcctaatttttaatacatagcaactgaggaaatgggaaagaaaacacatatcccaggatagagcacaaatgcaatgtgaactgaaggagttttgtagagggaagatcgagaaggtgctagctaaggcaggagaatggagaatatggagggcattagtgcagagacacaaaagaataaaatgtgaatggagctgaattgaaataacaccgaggatatttcataaatgaatcctggtctgtttcttcacttaatccctccaggacattcttccatctcttttccatgtgtttgatttcagggtaaagatcaaattattaggaaccttctgaatgaaaagccacctaggggttagcatattgaagggaatattctttatctacgtcagcaacaatggaggaaacatttttccttctatctgtgttgacactagaacaacataaggctgagtaacctttgcttagtctttgtcaactatgtaaccgctctgtccaatgttttctaagcctcgtatcaacaaagaaaataaacaccaggtccgtcaatattttttatgtctcatatttcaggaccttacacacaggagaaactaaagttacatgaatcgtggggtcagtgtagtctttgcttagttaatattccaccaaagttacacatctatcaaagcaccacacctaactccaactaattacaaaaatacttgtcttcagcatatcaatgaagatgttgagaataagaaaattgagcaacttattccacgggaactaagttagctaataaaatgtcttggtttattcattctacatttatctattaacaatttgagcataaatggcagttttgtaggtttttggccatgtaacaatcttaatggcagagtcaattttcaatcaatgaatcaatatttccaggaatatattggactccatgtgaataaaggcagggcaagtatttaatttcagaggtaagtgataacattcataaaatgtaactaagaacatggaaccaaaaatagtatcaccttcctaaatgttttctaataaaattgctacacatttagcactagaaaatattttacttgtattgaatgtttgaaattaagtcatcaaggaggtggcaaatgctccttccaatttccattcaaaagttggtcagcaatacagacagacaggcaggactcatgatcacaggttaacaatagagacaggcaggactcaatcacgtgttagcaatacagacaggcaggacccatgatcacacgttagcaatacagacaggcaggacccatgatcacacgttagcaatacagacaggcaggactcatggtcacacgttagcaatacagacaggcaggactcatggtcacacattagcaatatagacaggaaggactcacgatcacacgttagcaatacagacacagaaggactcatcacacgttagcaatacagacaggcaggactcatgatcacacgtcagcaatacaggcaggcaggactcatgatcacacgttagcaatacagacaggaaggactcatggtcacatgttaacatgggcacttccaagagctgcttggcgtgccatgaatggtttgtagggctacttgactgagaatgccctctggaaatgtttgtgaatccagttgaacaaagttgactaatgcggagatgctcaccaacttcgctactgttcctaagtaatccttgcaacaggatgattttgcctgttaattttgaattgctgaaagtgacactgaacattcttcagaaccaataccatattttctgtaatagctgcgttattggccgcagcaccgcagatgtttgcactagtccctgctagtccttcctgatcagtcaccacccctgatgctctgggagtccccgctaatccttcccgatcacagtcaccactctgatactctgggagtccctgctagcccttcctgatcacagtcgccaccctgatgctctgggaggaaccacatctccctagtactttcctcagagctgcagccacatctttattcctcaagctgtagatgagtgggttgagcatgggggtgaggatggtgtagaaggcagacaccactttatctttctctggagtgtggtaggagtggggcagcacgttggtgtagaaggctgccccgtagaaaacgctcaccaccataatgtgggaggaacacgtagcaaaggctttgcgccggccctcagcagagttcatcctgtggacagtcaggaggatgtgcgtgtaggacacagagatgacagatagagggataagcagcatcagcacgcagcaggcatacatcagggtctcatagagtgacgtgtctgtgcaagacaacttcagcacggctgggatctcacagaaaaagtgattgatctctcgggatctacagaaggggaaactcatagtgacaggagtcagcatgaacccatccaaggaaccaccaacccaggagccgaccaccatgaataagcaaaccctgcggttcatgaggagagggtaccgtagagggttgcacacagccacatagcggtcataggccatgagacccagcaggaagaattcccctccaatcagggtcaggtagaagatttgaactgcacagcccaggaaggaaatggtcttgtccttggacaggaggtcctggagcatcttggggacagtgatacagatgtagatggtatccatgatggagagctggctgagcaagaagtacatgggtgtgtggaggcgggagtccatgtggatgagcagaatcatgaccaagttggctgttatagccaccacaaagatggagaagactactgcaaagagaagcccggggaaggcaggatgggtgatgaggcctgtgaggacgaagttagtggagttctggagaagaccctccatgcccatggtccatgacaagctccttgggctgtaaaggcagaaatctggcagcttatttaacgacctgatatgtaggaagagcccaccaggaatagtatgtcagaagcagcgtgagatcaagaaaagatcacctacttcaggatcatttgaaatcctgggtttcagtattaatgatctgtatgatattggacagaaaattaatctctcaactcaatttcatcatctgtgaaaggtcatcatagttctgtactctacaggctggatgtgagatgtaaatgtaattcatacagtacctggtttagaatctgatttttactttgaactatcttctgaatacatttcataatcttatcacttttagattgaaagttttctgagggtggttactgtgccttatttcccatttcgcctagcgaaatgatttgaatttaaattgctctctgcatctccatcgagatgattgtactagagtcatccacagacgtctatttgtgacttaaattgatagaaaacatctagataactgacttttttggctgctgttgttactgaacagctttatgaaagtcaggaacatcaaagcagtacagatgacctcatttggggtcaggagccacactgtcttgtggttagacttttgtcctgcaaaaggagttcatcttttaggcatggactgctgtgagaacttgtgtctatttgttctcacagaataatttggggatcataaatctggcaggacaaccaccacaaactgcttcagaacagggctttagtttcgttatcctggtggtctttccagttgacaatgaattctgctaaaatttagatgctgcatcatagaattcaatcatgacctcatcttaaaatattgtttagccaaaatgttagagtttctctgacagagtggcatcctgaacctgtcctaatattatatcatcctagtaatccactgctacttgggttttttcctcaagtttatttctctaccattttactgatccttcatgtttataagtaaaaataactacagtcgggtgcagtggctcccacccgtgatcctagcactttgggtggccgaggcaggcagatcacttgaggtcaggactttgagaccagcctggccaacatggtgaaacctcatctctactaaaaatacaaagattaatcgggcatggtggcaggtgcctgtacaatcccagctactcaggaggctgaggaaggagaatcgcttgaacttgagaggcggaggttgcagtgagctgagatcgtgccattgcactccagcctgggggacaagagtaagactttgtctcaaaaaacaaaacaagaaaacaaaaactatagatggtaaagaaatttctgaactcagacgcgacacagcagtatcaaacattccttgaatcaatggaatgaattctcatgcttttttgagtaatatgaatgtgtgtcccttttatatgttcaggaatactgagggatgaatttttctttattagattatggtgtatttcttctcattttagtgacaggattactgaagaaacttgttttctgtcaaacgttttggccaccaatactacaaatgtatctgaatcttttggttctagaatagtcaaaatttacagtccctgaagcatcaaggaataaactctccttatgttgaagcaaaaacaatagcaacagtagagttttccttcttagtgctcagagatggagatatgagtaataggcctaaaagatgaataaacatccaaagggagaaagaaaaaaaagcaatttttgtgttggtctgtgctgaaacttcagtttgtcacaccttggttgaggagaaaaaaatacatgagcatcaaatattaactcctgtcaagcgtgataaaagtcagctacttttgccttctctaacaggtgaaagattttcttgtgatagccacagcttcgaatcatgggtcaagagactatttaaatatacaattccatttgcagtggcttttgcaatagcttgttggaaattaaaaatattaatctcgcagacagtaagtttgtcttgacccacatctattgtttcagttaaatgcattatggatattatacattaattactatagtgttaggttagctgacaatcatccttttaaaaatatactttgaggaactgaaataggcaagaatgagacaaatgaaaatgacctaagaaaataaccaattacttttgaatcagaacatgaaccagagcattttgtttcatgtaaataatcagactccacaaggtattcaaagaggaggtaaaacactattgcctcaaatgtctatgataaaaggataagaacgttttcaacccctagatcttatcttactgtaggatcccagaagaggagagtaaaaaagctgaaacaggagaaagatatgattttagccacctcatttttatacaaccgagaccgtgttaaaaaaaaaaaaaaaaaggttccttgtgagtgtgagcgttgtgcgtacatgtgtgtgtagtgtgttcatatgtgagtgtgtgagcatggtatgtgtggtgtgtgcatctgtgagtgggtggggatatgtgtagggaaaaggccctgctaaagagcagaactacactgcttggcacaaacgagcaattcacccatttcaatgaagccaatatttagaaccaaatgtgacatgttcaaatgcatgcctaatgttattccataggctactgggcattgcaagtagacagggaaaatatctgcattatggacaaaacatgtcatcagttacttctgtttacatcggttccgagcatctacattttaacattagagttgatgctatttagcattacgacgtgtggtttgacttattcacacatacaagatcctagattccattccccatcagctcatctttccctcactatcatcattctccactctaagacacttaggttccccttcatcaactagtctttccaaaaaaaaaaaaaaaaaaagaaaaagaaaaagaaaaagcttttatttgcgtgatcaaagcttcaggctcttcaaggcggcgaatgatttctccccagtgcagattagaacataacccagaacccctgacccccaggaccagttataacatcacccagtgttgcaacataatcatctggcaggaatgggagggtgggaagatcaagccgagaggtggaggacaccaagcacaggagctccacatctgttatctgcacacttggggctgatggatgagggatgagtgagctcgccaagaggcatttattctacctgtggtctgccacatggagaagagggaaaggagaatctctgcagggtgccaggtgatcaaagctgtatgtttcaggacaacagccctggagttgttctgggagaagccatagaaatcaagaacaattggtgactcaccgaaaattgaagagatctccaagagaagtcacaggttcttctaccagggagaagagcttagagcaattcattctgacacccctttctgggaattcagcatgactagagctatgagaagtatctgccagtgtcctttctgtggcaataaagctgctaaccagaactgatcttctccacttgacacaacgtacctgtaaagcttgaaagggaagggttttccattccatccttagagacagaatgcctgaagcacaaacacattccgtgttcaaaacactcacctagcactgggtgagctatgaagattgatagaactgacaatattcttaaggggcacatagttaagtttgattaatgtatcatatcaaaaatcctcatagaagcagatcattttaagtctaaagtggggatttctaaaaatgaaaatatattggggactttttaaaggtgtttagccacaaataacagctaatgccattgtgctttgctcagctgtcaaattgctctggggatgacacgcatagttacttctccagacctcagtgttctttcagtaaaagaatggcatgtcaccaacatgttactaatcctaagtgccacatagctctaagagtcatcgattatttgttcctgaatgagaaaaagggggccaaggatagtatattgggatctttctgctttgattaaagcttatgagagaagataatggtgtggaaggcactaagagacggaggaagagaaacaggaagtttggtattccccaaaccataaaccaatagggctttacgtgtgccaggtactttagaagttttacatacatgaagtcatagcaaaccagaagatgctatgcatcagtttgagtagtggacaaaggtacagtttccccttatcagtgggagacagttttcaagacccccactggatatctggaactgcagacagtactgagccctatatatataccatattttatcccatgcatacatacctatgatcaagttgaatttataagttaggcacagtaagagattaacaataataaaatagaatacctaagacaatatactgtggctataactttttcagtttgatgtgacagcaaaacttgcataattttttccttcatgatttcaaagataaagtttttcttaatatagatcttggcaaagtcagcttatgagggtttctctctccttaagtcaagaactttcacctttttagttaaagcaagcaccttacagcctctctttggcacatctaaatcgccagcttcactaactccatctctttggggccattaagaaaaactgagttacttgaacacaagcactgagtccgccacagtcgatttgataacctagacagctactgaatgactcggggtagcatagacagtgtgaatcaactacacagagggatgatatttccaccacactactcaaaatggtgggcaatttaaaatttgagatttttcatttaatattttttacacatggtagatagcaacctggcggattgcaggttaactaaaactatggaaatgaaagtgttaaagagaggaataccatgtcagaattctttacctcaaaggttcaaccctagggctagagactgaaaggatcttaaagcatgaaacttttgaagagcatctaagtgatcactgctttgaaaatagtggatcacaagaaccaggagaagacaggagtcagttcagttaaacagtgcaatagtagagagggaaaccggtctgattccgaaactcgagactgaaggagagaggacatgatcagagacaatgtaaataatgtcaaaaggctcgaaaatgggaattagcaggcactaggggtggaagagagaggggagagtccagtctaactacagctgaagagcccgtggagagctgaggtgtgtggggtggagtgcggctggaaagtgaaggcagagagaccagaactcagcgtcgagaaataaggtgcaaatgggagttgtttcagtcagaaagttacatgctgaaataaggtacttatgaaagatccacctggcagttttagtcttgaaagcaagattaatattaattgctactcataagtgttcatagccacagtgggctttggccaggaactccttttcttcttctacctacacaagctactcctgtactccgtctgcttttatgaatgaatgcatttggaccttgcttcctacattaatcagattttatccccttctctccacagcaacgtagtatccaatgatgtgaatttctcttttcccttaccttatctccagttctaattacatactgccttagttaccacccccctttatctgcctatttaaatggtaactgttttcattcgtggaaaagtagtctactttccctcccatcccaactgacaatttggaaattttcagtgtggaaagttaggcataagatagaagaggtttgcttggcttaaaaaaaaaacaaaacaaaatcagcactataatggcatgtaggtgaacatttattgaacacttactatgccagaaattagttcagtttgatgaatacaggttttaatgctacatgccaacttacctaaactacattgtcaaggatatcaccaatggactagaaagaaagaagtacatctagtttcctggagcattgagagtaaaaggtctaaattccaagctgccagcaggagggctgtgatgtggatgtgcaggggaatgcttctgggcagcagtgtcagttcgtgtggtggcaaatagaaatcaaaggatctggcatatggcccatccagtccaccctgctaacgctgtggaagaggaaatggagagtgagggcatggaggattacacaggagcagcagtggtgaggtgagatgaggtgaggcgagctgaggttggcccatctagtccaccctactaacgctatggaagaggaaatggagagtgagggcatggaggattacacaggaacagcagtggtgaggtgaggtgagctgaagcaaggggcagacacctgcagctataaacacaatgcactcattattatacccctacagtctgagcttccaacatgtccacatctccccctaggctccagttactcagctcaacaggcttttatatgccatgctaagatggcttctacgagacctctaatagttttattaaaaaaaaaaagattatcttaaggcacacgtggatgccttatgggttaaataaaagaggaaggaggttaaaatgaaataaagaataaaatcataatttccctccaagcatgaagtcttcagccacacctaaatgcatatgaacggaacaatcatttaacttaaaatgtaaattaaaattttaacaagatattcagagggcaatctatgcttatccaatagtatgcacccctgctaccaattaagtctgaaactttctcattgtgaataccaagcacattcttccaactgtcggctcttacatgccattttccttcagtaaatctattcatgttcttctgaactattagatttcccttagcttcccacgtttcatactaaatgcccttttccagttgtctgcttgccagatagtgaatatatgttatttatgcttaatcttgagaagaccactgcctcagttattagcagataagctcacagtagtaacgtggccttctaatagttacagagtaatacctgaagaaaacatcccagtatctgggtgatgttctgtttttcatgaagatctaaggatcctacctcagaagctgggtccaagtctttctaaagcagtagtggaatgtcagacttcttaaatacattgtgtaggggtgaggctaggtcaaaaagtcttttcactaagagtcccacatcccccaggaagaattcctgggttagcaattaatccaagttgactgggtttaccatgaactttagaagcagcctgtcctttcttgcagagggtgcattgttttcccaagtgaaggactggaatcgtttcttggtatttcatcatgaaaatgtcttactgaatcttggcatctctccagagagattttaaaggcagtgatgtggggataagagcctcgctctaaattgaaaattagattttaaatttctttagaaatagaggctatgacaaactaaaaaagctctttctcaaaagtcactagcctcttttgtttggggagaaatctttaaagttataaataagtgtgaatcaaaaagcattggagccaagtctcaatcaatgtagatgtttctggtgccaaggttgaggatgcacctgggaaaaaggaacacaagatgacaggagcatctgagatttgtgcttcttccaaagacggttgggagacttcaatatttaaaagggaaacagtgggcattagaggaaaaaagaaaaaggaagtgtgaataaatgaagtagtttccttctttccaggctttaatcagtgttgactgaattcgcactttagatgtgacaggagagggtttagaggaacactcaactgggcgttcatctcctgctcagtgaatctggattgtatataagataaggtgcacaatagaggaagcagtcaaatatgcatttgtttcaggggagtggagggatgactcccaggcctgtctactgcctgtcaagataagccattcatttacattgtcagcatgacattcaacagaatggttttcagggaaagatctttgggccagccaggaatttccttgctagcagattgtgagggaggtcccttggggaggtatgtagcctacctgtgtagctgtccattcaggaacagtatggaatctgtagccatacagtcaggtacagatatggaatatagttttgcatgacagagttcccaagcttgacttttccctttggcttagtgagtttgggtcccaagagattttccttctactttctcctatcttctattttcacaaaagtggcatttgtcacttaggttaagtgtttttcagaattatttgtcttacgtgtactacagaatattgaattcagtacgaataaaggagacataagaaaaatgatggaaataatgcaattggtagagaagaaaaaagtgagggtaatacaagttatgcattttctaaagttttcaccagagcacattaagatatttaaacattaggaaaattgaacttcctaacatttattttactaatggggaaaagaaggtggtcttattactaaatttttgcttcccaatcatcattgaatgcttttcatgcattaagtcagctaatgggcacattacttatgatttctagtcatcacaaatccattggacacatattttataccctctgttgcaggtaatcagaaaaccctatacctttttcagcctttagaatgtgattcaataattcctgaagaatattttatatgtcatccataaataaagttctccaactattggattgattggatacacttccctctggtgtgatgtgtctttctccagagccacaaatgggttacaaccaatattgatcctctcaaccctggattggtcttcagtgcccgatttggctacagccacaggggagttgattttgctgtcaacagccacatcagttttcctcaaggtgccatatcactaatttttatagttatgtcatgaaagcatttgagaagtgctgctgtatcagttgggaaaattgttaatacaagcccaacctaaggaaaaaataacagacctgtgaacagtgtattgattggtattagtttctaactcctgttcatgtgtcacaatactttgtctagtgttgaacttagttatatgatttagactttttacaagaggtattttgtggtgtcttaatcttccatgtttcttattcaccttttttctcttttccttccctttaactctcttcaggaagtaatccttttatatcatcagtaggtatagacttggttgctacaagccaagactgactcccacagtttggagtttagattctgttttaatttcagataattctgcctgcccactctcactccattccaaagtgccacttgacatttttgggtgaatctgtatttggcaaaaccttgctagctcctataagacttaatttttaagtgttctatatttctaaagatattggccctctgctcatgtctctgaaaaacagactattaattcattttcacactgctataaaacacccaagactgggtaatttatgaagaggttaagtgggctcagttccacatggctggggaggcctcacagccaatggtggaaggtgaaggagaagcaaaggcatgtcttacatggcagcaggcaagactcatgtgcaggggaaccaccctttgtaaaaccatcagatctcgtgagacttattcatcatgagaacagcatgggaaaaacccacccccaggattcaattaactcccaccaggcccctcccactacacatggggattataggagctacaattcaagatgatatttgggtggggaaacagccaaaccattatcagagacacattctaataagttcttaactggaggttctggcaagaaaaaaagatatgctgagattgccaagatctacagtaagaatgaatcttctttgaaattgtgtaggaggaaaaacacatttgtggtaattttgctgtcacacctcaaactgcaaaacctacagccacagtgtgtgataagtgcttaggtaagaaagaaaatgtattacatttatggtagaagatgagcaaatatgttgtgactgacagcagtcaggttctatagttctatactatggtttcaggcttcccccaaaaaagacttagaacacagcctgaggataagatggtgactgctatatttgaaatatgataaatatttgagttgattctttataatggtcaatggacagactgtctaaaggggaaaagtcgagagaagtcagggaagtagttgaagatgaccgtttttgtcatgactgagcagagccagaaacaggctactccatgatttttagtggaatacacaccttgttaagagctcatgggtgactactaaacctcaactttatgcctaccccagcccaaactgttcattgttcagagccttcatacctttcaaaaaaatgaaatccttaaaatcccaggcagctttccaaatcccataaatgccccacagttggtggcatgtgggtcacttgtttccaggcagagaatatttaaattcaagggcaatgataaagtcttgtatccttcatttcaagtctctagcagcatatgaaatttctttagaaagtggttacctttcctgaggacacacacctccccacaaccttctgtagggcccctgtgacatccttgttcctaaggctgtaaatgagtggattgagcatgggagtaaggatggtgtagaaggcagatacagctttgtcctgctcaggggtgtggtaagaatgaggcagcacgtatgtgtacatggcagccccatagaagaggctgacaaccaccatgtgtgaggagcaggtggccacagcctttcccctcccctctgcctcgctcatcctataaacagtaatgagaattcttgtgtaagagcccgagatgacagagaaagggatgaggagcatcataatacagcagacatacatggctgtctcgtaggctgatgtgtccgtgcaggagagcttcagaagggcaggcacctcgcagaagaagtggttgatctcccgagaggcacagaaggggaactgcatggtgacgggggtgagcaagaaaccatcgatagaccctcccagccaggctgccgccacaatcaaccagcagatcttgcggctcatgaggacaggatagtgcagagggttgcagatggctacgtagcgatcataggacatgagtcctaggaggaagaactcagcccctgctaaggtcaagtagaggaagtgttgggcagtgcatccagcaaaggaaatggctctctggctcatcacctggtcgaccagcattttgggcacaatggtggaaatatacaggatgtccctgagggagagctggctgagcaggaagtacatgggggtgtggaggcgggagtctatgtggatgagaatgatcttgaccacgttgctggctatggaggtcaaaaagaccaggagaatgagggcaaagagaagccaggggaaacgggcgttgctgaacaaacccagaaggataaagtcggcatacacggaataattgctctgctccatagctctgtagggtacacaaaagagatatgacaaagttggaaaggtatctgatttacataaaacattatgatgtagtcatgaacaaaccaaggtcaagtcgatcttatttcttgaagctcataatttccctgagagaactgcctgagcaggattgtgctacatctcattataccatcattgttcatttaaggattttcttgatttggtgattactatttagagttcatgatcaaacaatctttttgttcatgaccatttatttctgtctttcgagtaccaccttacattggtgaggatgcatataagacataagaatggaaccagcctgattcaataggatagggtggtggggaggaaaggaggattgtccacatcctacactgctctccttatactagactctaagttctcacacttagaatccagtttgaagatcaccacgagtatatatttgcctatggaagaataactgcattatttgacctaatttacaccattcttgacacacttgtacattgtaaaatgagtactcaacttacatgtatcaggtggagtattgcagaatgagcctgtgttgaataaaaagagctgagttctgagaagtcatccaagaattcataggaggaaaaatcatgggagaaaacgttgagggtcaagtggtgtttgctttccttcttgcagcagcaaactaccaattattaacatacaactcgttaaagtgttagaatcccatttaacttatgaaaaaataaactagtttaagtattagacctagtgtatcccaaaaagaagggatctctcatacttgaagttagattctgcatatgtatccatatcagttaaatattttaccacaatttaggaacacttgagttatttggatagcttctccctgcatcatatagatctgcactatccagggtggtagccatgaggcttatgaagctgtggagcccctgaaacacgactgctccaaatcaagatgtgccatgagcacaaagttaattcaaacacctgttaaaaatatatgcaacacatctccttaaaactttatattatggtaacttttagatatatttggataatatagattaaaattagtttcacctattttttacatttttaatgtggttactagaaaatttagaattctctgtggctcccctaggatttctactaggcagcactggtctagagttatccctgagaatatgacagctccaaataccttcatccaaacaagtcctccagagttaaacacaccacaaattagaattgagccaaaaaatttaggtgtgtaccaaattagaaaaatggctttacttgtatatgcattcaccctcaaatagcagtaagaacattaataagtgattcgtaaattttacgtttccaaacaactttgtaagatactagaccattctacagttgaaaattaggcttaaggaaacttccccaaggaggaacattgttctttaaacagtgacagtgtaattgttctatgctgttttccaacaggacaaagtagacatcaattcattccataaatatttctcaagaggcacattgggtaagccaaagtttgatattctgaaaggccctgaaagaatgtaagacatcatctgtcttcgagcctagaattgaggcacatgaacgtgtgttgtgtgaccacaggtgcactttcagaatggttttaagacctcagcaggtttgacttatttggtatgtgaacaaaggacaataaaaatgatggaagctgcagcccactggctggtagacaggaacttcacaccagggcccctcagtacaattccaccacaaccatgccacagtggatggatggaaaacgatgaaaattcagatttttactgatgaaacccacattatatccttatgcatttttcagttctcattcttgaaatattaccagctttatgccagagctttccatcagctgatttataatgtatctttattattttaaaaactgttaaaccagtgggaaaattaaaggcaaacatttagtagcaattcgtatgatggagagtgctgaatgctcacccagacctggttgtccataatttaataagaacaagatccttggagggccgtgcttgttatttcacagtaaattcagagaatgatggctacctactggggaccagccacagtgactgctattggtccactgggaatattaaagcccaagatgaaaaaattggtccaaaaatatccttatcagggcagctgtgtcctgaaccctgaccatgaatactcctggccctgaaacttgctaatgagaccctggggatctccccagcttacttcacaaagggaaaggggagatatgagtggctccataaccactcagattttacaaccatcttccaactctggtagtgttgattcattcactgtattttaagagttacccagtatagcaacatttaagaatacttggaaaataaaggaatcaactggattatgccatgccccatgtaataactgtctatgcataattccaaaccttagtaaacgtccagttctatgtatacctaataattagcacatctttcccagtctttatagagaatattgctgtgattgaatatgagacactcagcttggttcacattcacgttgttgagtttgcttataatgcaagtattgtgaggtgaattctctggcataattcatggacaacggtttactatgctttagaagcttatcaccaagttgttaaatgcttaacagtaagagaacacacttgcggcagcatcatgcttgccccagcatttagcactagtatcaaaactcacaatatggatttgattatgaaaaaaattgaacatagtgtatattttggctattttgatttttcatgaccttttctatatataggtgatttgtcgagattagtctatagatttttattttttattaatattcttttgttctatttagtgcagctattttgccccccgagttacatacatgtaattgtaactttgatgtttaggccaaaaagttttgaaatatttcagacattttcattctgtgtgctggatttttgaaaaaaatattttccatcgaggtatgtgattaatatacaatttaaaatttttaatgtaatttctatgcacttaaaatctttggtctagacattaaaactatgcaaccattggtttatgagatcaacaatgataaatttgtactttaagatcatgccagtgaattctatctaattggagttcttcaaataagcaggagttcaagtgtgaatgatgagcaggaatgacctaagtaacaaggagaactgttggaaatgtgggaacactgtcatgggtaaaattagttttcacccttgttgcatgtacaaattctggtataaaaagcgagtactaaaaatgagtgccaggttaaccttaagactgtgatagcgacagttagctttgggaatctcaccctttgctgtccattatgtttttctcttcaatagcaggtccagcagcaggtagccaagttttctactttttcatttttgttgtcgttctgtcagaccctgctctgcatcaaagattggcacaattcttggtgaccatctaactcagaatacgtttgagtgctaaaaggctaagctagacaggacatgaggacaacaggcataagaaagggaatatcttgagaagacagggctaaatggtgaccctgactataagacatttaattctctgtacaatcagattcattatgtttcctccccagcagtattttcacatgaagtgtcacttctagaaaatggcttttcttccacaactaaagtaaaatcacttggggaatctttagaacgatagagaagttttgattaaggccgagggattgtcttgaagcagaccaagggcatgatcaccttcagtctctacagaagttgaactgagttcttcccctgtctattcctaacccttgaaacattcttggcatgtttaatgttcacaatgctacatgacatggtttttaatcaaagctggctttatattctatcttcatcactgataagcttctggacgtctggcaagccactcacattcttttcagcttctgggaacttctaagtattaagtatgctgcaatggtttctcggagcaggatatggagggtcttcctaactaaaccatttttagagatgcttatgaggtacctaaacaaggtggaatactacgatttagataagctctttatgaagattttaaaattataggtgaatatatgttgcaatgataaaatctgttggaatcattatgcagacagatctgcatagaattcaagtaatctgctacattctgatgtacagaaaagataagagtccataactactaagaaacgagattgaattatctaagatttatatattagtaccatccacaagtatctgcagttcaaagtcagatgtatcaacttcaacattctccagtatttctctggtttgaaccaaaactttctaggaagtccagaatctatttaaagcatcctgcgattgatcagcatcaagactgcaaacttaccttacacagtatcttccccaaacacgatgatctgaatatttagagagaaaccttacagaactaaggtagtacatgcaattgttcagcatttccttttatgtagtaagtatggggaactaagaggcatacatcagactttctaaactggaggtattctatgttctgtatttcaaacttgttttctgaactgaaacagtacaggcagggagagtatgaattcaaacaagaaggtacagtggattaggcgtgggaattacatcttgttggcagaaggataagggtcagtccctaacttattgagactttttaaaatacagtgataggtgaatcctttgaagatctagaaatagaacagcctgaatctgtaaatgcctaacgtcagttgacagcagctgcattatgcaggctgttaagaagatagagatccagtgacaaatagagcttgcatcatggtgatggctagtactcccattcaggagatacattgacatcactgtctctggggtccttgtccctagcctgcaattacagttcatataaaatgtgacagactccttaagaaaaatgtaacctctcaatttacaaagtaaacacccaagataagtcaggttgctggcagctgcaacttaaattgcttttttctcttttactttgttcacgacattgttttgaaagtttctctttttacacttccaactttcgggcatctctcttgaaatagaaatcaatgtttctaaggaagtattgtcttgcaaaagatacattttgggccattccccatcactcaagtattagtatgtaatcatcctgtctttcttgtaacttgtaatacataaaactttcagcattgcaagcatttaaaaatattcattttactgatctcagtgtatataagatctttgagttacttcaagaagacagaccttttctcatccagtattctcaaaagggcccacaacgattcctggggggagcggggaagggtgggggggaattttagaccctgcagtcttgttgtgctgcaatctatgcctgcatgatcttggctttcatgtaattcatatttacctcactggtgtttaaattagtgggggttggaattcaggttttctgaggctgaagcttatgcaatctggggcatcttaagaaaacaggctacaaatcatgattgcacaggtataatattctcttcagtgaaactccaacaaaattacacctttagaaagctgacaaaataccacaaagaaatacataaacaccccaacttaaatcttaactggttgaacttaccacttaccattttttccaacaactggctacattactatgtactctaatattttctataagcaagaagagatgattcaatcctagtacggttggttgaaatttttaaattttttggtagtttagaaaattctttgggtctttcccctttgttcaggattgaggtccaatctgagaaagccactgttaaattactttcatatatgacctgccttagcttccccaaaaattgaccttagaaaatatttgaaactgagaaaaatgattcagagcagtctgaagaatgtgagctttaccaaacgtcttaggctcagagacacgagcatgagaattcaataacttccctacccagccctgctcacacatgcgcacctggggttgtttaaaggaattttatacttccccccgctcccccgaagtttccagactagctgataagttacctaaaatgttacaagttgtacaatatgacctttaccaaccatcttcatgttccctacagagaatagtgtatagctgatcaatagctacaaaagaacaatgtctagttgatcaatagtttatgtcagcttagaacttctcttttcccttagaggccccattataactgctgttagttggagcatttatttaaggctactagaatctgtctcctcagattgcatttcccaatcttggtccaaatatacgtgttaactttgcctcaagttttttcctttaggttgatacaaccatcaccaccatccatctccaggactttttcctcatcccaaacaaatcttctgtacccattaaacattaactctattttctccttttcctcatctctggggtaaggtgtattctgtttctgtggattttcctcttctaggtactgtagcaaacctgtacaattgctacttgagacggtcactaccgcagttactgttactgcttgagatgctcattacagggctgagcgaagggagggaggtagaagtggggggaaaacactgttcgaaggctaagctcggggaagaagagctcccagcttctagtgagcaagggcagccgccccagcttctcagccctccgcatggatcgagtaggagcagggaggaggacgcacgattgatcagctgcgtgattgatcgcaggtgcacatggttgcgatcggaccttcccacgcacctaatgacacactcgtgcctgcgcgtgacgccctccgctccacctccgcgcggaaacgcagtctctcagtttgccaacattctgcatttgtgagaagcagttttgctgcttactcgtccggcctccagtggtaaaccgagccgatcgcgaccctcgccctttctgcctccaacccttttttaaattatgtctgtccctgtattatgggggttgaggtcagcgggactgcggtcggccctcggtcccgagggcacccacacggttcatctcctgtaaagacacaggcatgtcctgtccccacgttagtaactctacaaaagcaaaaagctttctggggctgcagccgggagccaggccattgctgaggcctccgctccacaagctgcggcgcagcttctgcctcttggcctaattgctgcggggtaaaactttccgttgatagtgaaagcagctttttctgatgaacagaaggcacagagaaaacaagttgaggcttatccttctcgtgcaacagtgtagcaaaaaagcaatccttaaaccttccatttgcacttacacaggcgggtctattagatgctgtgggttgtgatagctttctcccagctgtacttccaaatgcctgacctcctcgcttcttacgtagagaagggtacaatttacaggggatgagcaacagctgcgcaatatattctcctgcttcaaaacccagagatcttgggacatgaccgctacctgaatttctccataagccgaagaactcctgggacttcagtaatgccccgcaagttaagatgacttttgcctaaaattaatcccacctatcctgttggcaaaggtccccaaacgccagtgtgagtcaggttgctttccccccaaagccggttgctttcccctaaacccgttcgtttgggagatctaatcctgtgcttcctactgcgtgaggagggggagtcaaagcacctccagaaacccccctgaaacggagttgtggcctggactggggaagtccttgttcgaggtgcccaggtccaggcccgcttctggtttccccacagggagtgccgttctggtcaaatatagagtagcattgattagcctagtgatttcccttatttcaacgacggcaaagtcctggcactttttctgttgagaactgttttaagaccccttctgcccagaggtctgacggcattctcttttgcaacgtccaattctctacacttacaacttttccactctagggctcaacccttggctccttttagatctgtcaactaccaaaattagctgttgcctgaatcaacattataaagtagtgaagctcagttcccacatcttgaaaaactacgaaaacctcctgaactttctgcacacctcacaggtgccactgcacgttcccaatccacatttgtagcctcaataagccatagtcaaagtgagcatttctgtagccacaaaagatgctgccagccagttttcattctccctcttgtctaccacttttgataggtgctctaagtggggcaaaacagtctctccggccctgaaataacggaaaaggtatgtaccaaactccaaatgaaagaaaaaaataaccaaattcttccccatgctaccctgattcaaaaacttcccgttcttcaaacctctggggcactgacaagtacctttttagagcactagccttatgttgctgctggctgacttgtaatggggtttctcgtttgtctggctagttttagcttctgttccagcagaccttcctcgttcaagtctctataggaacctgtctgtccctgcaagtttctgctagtctctgctagtctttatctatccctatctgtccccatggtccctgttagttcctgcaagttcctgtctttccctacctatactctgtctttctctctatccctgctgatctatttatccctccaggcctcttcaggtctgtacttgtccctagatgcccctgttcaggcaacacttgtgacagacttgtacaattactacttgaaaccatcattacaggactgaatgaagaaatgaatgtagaaatagtaacaaaagacagaagaaaacggttttaaggaaaggctcgcttaggggaagaagagagatcccagctcctagtcagtaaaggcagccgcccgaacttctcagccctccgtatttattgggtagaaagagcagggaggaggacgtcacgattggtcaactacttgattgattacaggttcacatcattgctatcagactttcagacgtacctaataataacaaacacttgtgcctggggcgtgaccgccctcagcataacctctgtgtggcaaacgcagtttgtcagtttgccaacattctgcatttatgagaagcagttttgctgcttactcacccagcctccagtggggtactcagttgatcacgaccctcactctttcggcctccaacagggtacctcaaatgagtagaatcatacaatatctgcctttatacttacttcacttcattttcagggttcatccatgtggcagtaaatatcagagtttcattccttttgaaggcggaatagtatcacattgcttgtatatatcacattttgctcatttatttgtctattgatggacacaacattttggctaccgtaaataatggagctatgaacattgttgtacaattttctgagttcatgattttaattcttttaaatttcaaaaataattttgaaattcttttgaatggtatcttcaataagttgagacacatacatttgttgtgtaagtcactgagattttggggtgttgtaagtaagtcctatgaaggactcagtgtgagcagactggtgcactgttctcccttttcatggatgcataggaatatggtcagggctagaatgacaacacactggctatttaccttgaaagactttaacataataataaagggagtttaaaaaggaactgattgtttgagatactgaagaaatagaaatagattcagagattaatgaagatagatacttagagccagaactacagttagaaacagagatatagattcaatgttctctctctcccaagatagacagatagctagatagatagccggaggatatgaatacaatttggcaagctgattcttaaaaagatgatcaaagagccaagaatagcagccaagataatgttaaataagaacaacgcagataaatggtcatgccagaaattcagacttactttcaagttaaaccgttaaacagtatacaactcacacatcacaagacaaaccaaaaaaaaaaaaaaagaataaagagttcagaaataggtccatgcatctacagaaattttatgaaaccttatttcatctgacaaatgtttgttgaatttatactatgtacagccatctattgaactattaagacccttgggatatatttgtttgcaaaataggtgcctgtcctcatgaagctgcccatgtagcccagaggcagtgaaaaataataaacagaagaaagaagttaactatatagtctgtcaatgtcaaatggtatagagaaagggaaaaagtagattaagagagagaaagaattgccgaagctgtggtaacgtttgttgctttttacaatgtcatcgatagtacagatctctttggaaggataacattcatgcagtcttgaggacataaagaatttagccctgaagagagtgttggggtgggagggatcccaagtggagaaaaaaaaaaaaaaactggtgggacaggcctgaggtgagagtgtacatggcttattcaaagaatgacaagaaggccaggatggctggagcagtgagggaaacagtggcacaagcagacatctaagaggtaatggggcagaggagcatgtaaaagggccctgtagagcttcctgtaagaattttagattttactcccaataaacagtgagcgacagtggggttttaatcaccaaagtggcatgatctgacgtttcttcaactgttgctttagaaataacccttagaggatttaggtaaagcaggaacatattgtagaaatggttggaacctagatgtcttctgaaggtagagccaacaggattcctttactagttggatatctgattcaagggaaagagaagcaccaggggcaactctaagggcttggattgagcaactgaaattgtggacctcctaccactgggcctaaggaaagacgcagttgcaggaagtttagggtgggaagacagaggcacagatcagtttggtgaatgccaagtttgctttgaactgcagtcattaatacatagatattattatatagatacatgtttatagctaagaaccccaatgagcttaacagagaaaaggtacaggaaaaaaaagaagaggacccataactgagctaggagccctccagtattaagaagtgagcctggagaaatgacacaaggagaaaaaaaattaaaaggaaaaacaaaacaatgagttaggaaaagccatcagtatggtgtacttgaagacagatgaaaatgcaacaaaacaaaatacacatcttcaatcgagggaacagacagttatatcaaaacaaggaaaaaaacagacaaacaaaaactgtgctgattgccctgaaagatttgatttatccacataaagatcattgaaatgagaggtaaatatcctgaatagagaggacagtggaggaattagggagaccaagagcaggcaaagcttttatggaatgtgactataaaggagacagagatgtcactgcagatctgggaaaaataaatttatcaagttgtattgggaaaattgtttgttcatatggggaatggaaaatttgcctaaagtcacataccacagatatgttttaggcgggttaaaaactaaaaggtgaagaaagaaaaaaaaaaaactatgagcttttagaagataggataatattttcttgacttcaggttatgaacagattacttaagacaaaaaaggctaatataaagtaaaatattggtaattcaatttacaaataaaatttgaacacttggataggtcacaaactagcagatgtgtaacaaaactgaaaacaaaatatccagcacatgtataaaaaaattcttatgtgtctataacaaaaggccaaaatttgatagcaaatgggaaaaatacttgaataggtactttacaaaagggaaactctaaatggctaataaatcaaagaaaacttactcaacctcattataagtcagaaaaatacatacccatcaattctacccataggtatatgcactatattttttgcatttatatatgaaaacataaggacataaatgtcaatagcaaaagcattcataatagcctgaagctgaaaataacatacataccaaataactatagaataaatatatcaattaagatattcaatgactttgcatatgctaaggaaaatgagcaaaccatacacgataatgagctgaatatcacaaaaattatatttagcaaaaaagtcaaaaaaatattcaaagtaacttcatttttaaagttcaaaaatagacaagagtaaactctgttgtttagagatagatactgtattagtccgtcctcgtgctgccataaagacatacctgggactgggtaatttatggagaaaagaggtttaattgactcacagttgcttaggcttcacagaaagctggctggggaggccccgggaaacacacaatcatgggggaaggtggaggggaagcaggtacaatatttacaaggctgagcaggagagagagagtgaaaggggaagtgcttcacactttcaagcaactagatctcaggagaactcactcagaatcatgagcacagcaagggggaaatccaccccaggatccaatcacctcctaccagctacctccctgaacactgggaattacaattcaacatgagatttaggtggggacacagagccaaaccatattgacacataagatgtaaaactatgaaaataataaaggaaactagtcacctatcagctaaatgacagtacctgattcattcaggccaaaatgtgaaagtattactaaccacaggttcttgggctcctgtgcaatagaaatggacatgagaccaagcaagttttccagacaaggctttattaagggcttatgctcgaacacaagggagacagcactggaatgacagttctctggctggttccccatggctaggtctttgctgtgttttaagatgagtgacgtggataatcatgaggtatgggaggctctttatacatgtggagtggagcacaggatatgcaggcacagtgagaaattatgtgaacacatacattgcatgatcaaaaaatggtaggtaagcccttccctgggtggagattttagtattataatgaagcaaggggtaaagatcagtcattcttctggtcttaggcacacgtgagtgataaggttaactcccttgaataagatttatggtggaatgctgcttaacttagtttcttcaagttatccatccagtgggtatcgtgccagtggaggtggtggtgcaaggtctggaagttggcaggtacgggaaaaaaatgtgatagtaggagtgggggccaagccctgtccttactgtgtctcagaagtaggttatgtgtattgatacagttcagacacacattctgtccctgatataatgaactgatacagttcacagacacattctatccctgatgtaatgaactgatacagttcagagacacattctatccctgatataatgaacggatacagttcatagacacattctatccctgatataatgaacggatacagttcagacacaccttatatccctgatataatgaactgatacagttcagagacacattctatccctgatataatgaatgcatacagttcagacacattctatccctgatataatgaacggatacagttcagacacattctatccctcttagtgatgctaagcctaagaatctaggagtatagaaactgtagcaaaatcccgtataaatggactgcatagaccacatgagctgtgtttggacttccctgtgaatgagatgggtcacaccataagatgatagatagtatcaaaactttgcaaagtttataattagtgctacggggggggggggcgggggggaagtaagacattttttccttgctcatcaaaaggttcgtggttggtaacttctaacaaaagacagattagcaacagaaaagtatagcaaatttacttagtagaagtttcatgaggcatgcgagccttaaaagtatgattagaacatttaaaaatatgatataatggaaataaacttaggaggaggacttagtgaggtttgttcagattcttagtggcctccccatgtgacatttttttccctctgggcattggtcagggcccctctggaataaggggcttattaccttctctcagaacaggtaggtctgagaattcttttgtggacagctctcaggggagaagggcagaaaaaatcagaaagtgacctttctacctcttcggttttctcagttttcttcagcttatttagtatgtcaagtttgcatctgatgaaaaagctgaacactgtaaaatatttaaagaggtttattctgagccaatatgagtgacgatggccagggaaaagcctcagaagatcctgagaaagtgtgcccagggtaacttctgtctccctaaaacttagggaaagaacttgcaggcaaagtcataaatcaatacatgtaaaatatacattgttccagcctgaaaaagcaggacatgaagtggaaggcttataagtcatacgtggatgcaaagatttttctgattggcaattggttgaaagagttaaactaaagacttgaagtcagtagaaaaaaatgtttgagttaaggtaagggagtttgtggaagctaagattcttgttacatatatgaagcctccatgtagctggcttcagaaagaatagatggtaaatgtctctttttggaccttaaaaggtgtgagcctcacagtttatctttcctagatctggaaaaggcctagctgcactaatggcagatgcaaaatttcccccacaaaagatagctttgcagggccatttcgaaatctgtcatataaatatattttgtggtaaaatatttttatttctttcagtgtctactatctgtcatgtgatgctatatgggagtcaggttggaatttggtatcttattgttttgtcagtcctgtgatctctattttaatgttaattccacaatggagggagtgcaacaaggtgtgcccaatcccccttccctcatggcctgaaatttactttttcagattgctctcagctccactggccaagaagggggatccattcagttgattgggcggcttaggattttacttttagatttcatcaagaagccatatttggaaggatcatgttctgaaccctgacagaggagtttaaaatttttcacatctgtctattaactcatcatagactaaactagtttatgcagttaaataaaataatgaactatttcaaaacaaaatttgactctagtagacagtgtctgcacaatcatagcaatccagttgtgaaaaatgttataaaagaaccaagaaataaccatgtgactacaaaacaatgagggattaggcatcagaagactgaaaataagcaacatagttgagtgtactctattttccatctctctcattttattgtatttactcttgcattccatgagacagtgtttctgcctctatccaaaattagacctcctacttgggctttgtgttgcaacctcagaaaataataataataataataataaatcccaagccctgtcattgactgattggaaactctcttgcccagggagatctcaaagaaatctgaaaaactagttcaggccatgcgggaagggaggtcagacatgactccttgtatgccatccctttggagtttaggcaaaactgaccagtattgacattaacacagtgattataagactgacaaaacagactgtagcaacaatagcagattccaacctgactctggtgtagaatcacatgacaggtaacaggccctgaaggaaataaaatattttaccccaaaatgtatttctttgacatgttttggaatggccctgcaaagccaattcttctgggggaaatctgaattctgtatagaatttgcttccctttctaagtcctcgtgaggatccagaaaacatttaactaagagtctgacaccttttaccatctatcctctctgaagcctgctacttagaagctttcataggttgattaaaaaattcttgactggcagttggttgaaagagttaaactaaacacttgaggtctctagcattaccattgaatgctaaatgactgaccagcattaacattaaaacagagatcatgagactgacaaaacagattctaggtggtaataagatactaaatttcaacctgactctcatatagcaccacatgacagatagcaaaccatgaagtaaataaaaatactttaccctggaacatacttatttgacaaattttgaaatggtcctgcaaaggtatcttttgtgggggaaattttgcatctgtagagaaacttgattaatgccgctaagccttttccagatccaggagagagtaaatgagagtctgacatcttctaaggtgcaagagagacatttgtcaactattctttctaaagcctgctacatggaaacttcatctacataacaagaacgttggcttccaggaccccgttatcttaactcgagcatttctttctataacaaaaaccttggcttccacaactatgtaatcttaagcattcctttctactgacattttaagtctttagacaaagcttaactcaaacagttgccaatcagaaaatctttgaatctatttttgacttgtaaaccttgactttaagatgtctaaactttctggaaccaatgtatatccctcatgtattgatttatctctttgattgtaacttttgtctccctaaaatgtatcaaaccaagctataacccaaccacattgggcacatattctcaggaccatctggggctgtgtcctgggccatttggctcagaataaacctcttcaaatattttagagtttcacttttcttcatcaacattatttggtgcccaatgcaggacctcagagaagactaaggactcttctccccaaaaggagtcatgtgaacttggaaataaggtaccaatttgggcttgttaccagtggaaagtcttgactacaagttgtccaggtcctgctcccagaccttggtgttttctcttttaggaagttagcataaattggccttaagttccctgtctccaggtctccagaccatattctcctgctgcaggcttattgaaagcctcctgactttgaggttctccataggtggaactggtaagtaagtactcctgagccacagatcccttatgtagttaatagtactttggtttattctgagctggtcttttcctgggaacttgtttcagattctaattttggattcacaggttcattctagagttttctccattgcttttttctccaaaaattagtctcaattggttcatctgtgcatttgcttgaaaaacctgatgtttgtataagtgaatgagagacaacttctgagccccactgcactgaaacccacgctacagtctggctcctccactaaaaaacaaacaaacaaaaaaaaaaacttgcaaagcaaattctcaaagattgagaaaagacaaggagatgacctcctttggggcacccctgggggttttatggcactctacttgcaaatgtttgtgtaaatgtgaaggtttgagagcatgcttggttttctagtactctggctggttatgtattatagtctgttctggcacatttttaaactgatgggtaaattcagagctcaaagttgacctgcaactatagaattaaatatagcatctcctaaattctcaatttctctattttatttttctgttttaaatgtactgttgcttttctactggttttgagataaaacccattgtttaaattaaaccatcttttgcaagctggtgaatctgtattgctgtcttgtgactagagttctgaaataaaacctatgggatctttgtatctgtgtatctatgttgagttgtgtttatgttacatgtacatgtattttcttatatgttgtaactgcaaggtatcaaatgggcttaaaaataaaggattactcataaagtccaaatgctcttcaagttcacatgacaagtaaatcttcaataaataagctggctttataattattagtaaaataaaatttgaaatgccttcagaattgtcagcatacatttttgtctggatttattggtgaaatagttttatatttagcggtgtttgtattataaggtaccaaactttgtcatgaaggttataaaactttaaaacccatcccttaatgatcattgtgtaattttttataaataagacatttaatactgttgatttattgaaaataggtaaaaccttagtggttggccaaaaaaaaatcaaataaacatatatttaacatttggttcttatgtaggtaaacacctgaaatattcacagcctataagaatggttagctgaaaaataactttaatgatgactagctttgtctaatatgtcagtttttgtaagtaacctaggaaaactgttttaaaaaataaattaggtagctttaatggcataaatgcttataaatgaacttgtcatataatttaaaatcttaaagttaaagtaaataatactcattaagtgtctggatcatttctaatttaaaaaacagaaaaacatatttctaaaataatataaaatggttctcatctataaaatactgatatatgacagacaattcaagatttactacttcctaggttttcacaaaaatttaaggttctaagaataaaaattctagttaatatataattctgtatttagagagtaccaaagtaaatatttttatggaaaagaaattataataaagacataaaaatatgttcttattaaaaggaaaataatctttgtcaaattcaaaggctattatacaaatccaaagatgtatttatttttaaaaatgggtaaaaagtataattttgtatgagaaagagacttgtatagtaaatgtagttctaaaataaaacaactcattatttaagagggaaattttggacaaaacagaaagtccaagtatgtcataaatagtctgtgtaagatatgataaggtttataaagagaatttatgaaagaaaagtttttggagactaaagctactctttcttagatgggaggctcaagtaactccatcttgaatggtgatctgccctattggcttctgattaactccaggggggaaggcctttaagatttccagtttatttattgctcctcgtgtaagaacaggtacttattataaatcctgcccttaggtcaaacaacttttatgttatcatacttcaattgtcctacacatgccttctgaatcattccttccctatggcatataagtcctgggttttggggttaatggcacaggaatttgccatctcatctcactgctgcctgagacacacacatggcttctgttcataagtccctattaattgtttctgcctaagaaactgtatttatcagcctctatcttcagcatctcagcttcctccaactttggataggtttgtatagacctgctcattgtgaaacaattttgtatgtgactaagttgtcgataacttaaaaagaattatttgtattagtgtttctagagattgggatttaatattaaaaatacacaaatagaaaaactacctatagggtactatgcttattacttggaagatgaaataatctgtacaccaatcccttgtgacatgcaatttacctatatgacacctacacaagtacttctgaacctatgtaattggattgtttgtaatgcaaaggataaatgcttaagaagataaatgccgcatcctccatgatgggcttatttcacactgcatgcctgtatcaaaacatctcatgtattccacaaatatatacacctaacatatacccacagaaattttgaaaaataatttgtggattaaaaccaaaatgacactctaaaaaaattaattttttatgtagcagtattcagatgtggggcctttaagaggtgatttggttgtgaggcctctgctctcataaatgaattaattaattcatggattaatggattatcatagaagtgagattaactttataagaagaagagagatcttggctagcacatcagactgctcagctccctcatcatgtaatgtcctgtgccacctcatgctctgcagggaatccacactggcagaagtgtccccactggtccacctgaggctctgcagggagtccccgctggcagaagggtccccactggtccaccttaggttctgcagggagtctgcgctggcaggagggtccccactggtccgcctgaggctgtgcagggagtccgtgctggcaggagggtccccactggtctgcctgaggctctgcagggagtccccgctggcaggagggtccccactggtctgcctgaggctctgcagggagtccacgctggcaggagggtccccactggtccggcttaggctctgcagggagtccctgctggcaggagggtccccactcatccacctgaggctctgcagggagtccccgcaggcaggagggtccccactggtccccctgatgctctgcagggagtccctgctggcaggagggtccccactcatccacctgaggctctgcagggagtccctgcaggcaggagggtccccactggtccccctgatgctctgcagggagtccgtgctggcaggagggtccccactggtcctgctgaggctcttcagggagtccctgctggcaggagggtccccactcatccgcctgaggctctgcagggagtccccgcaggcaggagggtccccactggtccccctgatgctctgcagggagtccctgctggcaggagggtccccactcatctgcctgaggctctgcagggagtccccgcaggcaggagggtccccactggtccccctgatgctctgcagggagtccgtgctggcaggagggtccccactggtctgcctgaggctctgcagggagtccgtgctggcaggagggccctcgctgcatgtggacccttgcccttggacttctcagcctacataattgtaaggaataaatgtattttctttatagaaaatgaactaagagaatgttatgggttttcataaaagtgaatttttaaaattcctcatattaggaaacataaagaggtagtggaatatttatttaaatattgttttaacataaaccctactatttaattattctacatatgcgcattttatgtgtgttaactagaaacagggctaggcagccttagtggaactatggtctatttcaaactaaaatctatgtattaatatatttattaaatagtagtacttaatgaaattactgaagctttctagtgtcataaactgatgaaaatataagagttggacaagagagggagaggtgttttctcatcaacagattggttcattttggacattacatggcaatggaaaggaaggtgtagttccctgccatggttttagcacaactctttgaaaacacaagcagcaaagttgccactgtgattcagtgattgagaaaaaattacttaaatattctgaaattttaataacacgttaggaataaatgttatatactgtttttacatataaaaaataaaattgattacagctgtagaaaatgaaactctaaaacaactagaaaatatatgggtaaagatttgtctaatgtataaacaaagacaacaaacaaaataccatgtattcatggatataaagatgtcaacaattgaaaccagggactgctagatggggaacgagtcgggggagataaaggttagaaagctaactactgggtgctatgctcagttcttgggtaatgggatcacccataactcaaacctcagcatcacacgctatacccaggtaagaaacctgcacatgtaccccctgaatctaaaatgaaagttgaaaaaacaaagtaaatactatggaaaataaattaggatttgaaaagagaaaaaatatatatatatatatatttgggaattaaagagtagattattattttacttggaaaatttttttggatctatgacaaagcaaaagataaagattagtaacatatagccatcacttagatattattaatatcagaataatgtagacatattttttaattgcacactttactaaaaaagaatttgcagataacacaaatacaagacattaatgataaaaatgtaaactatatccagaatatctacaacaagatctcactcttactgctgaattacagaaagaaaaaaaataaatgatcatcagtactgttgtgaataaagtaaaaagatgtcaccaggttctgccctctgtcatgatagattgttgagaggaagcaacttggatatataaattagaaatgaacacttttttatttaaagacctatcacaaagagaatcgaggaattctttacatagatattcatttcagtgttgttttagataagcaaaaattttaataagcctacatttaaaataagagaaaaatgttttataaattctgtttcaaaggcaaaatgttatgaaactttaaattatatccaaaaatgtaatatttcttaaagtaactaaagacatgagcctctgtacacaattttatttatgcagatatagagctatatatggcatgattctatagtatatatagaatctatggtatattctatatgatatatagtatatatacttctatagtatatatagaatataaaaaagatactatatattatccatattatatattaaaaatatatattgaaaataaatttttataggaaatatatttgatgatggtattgcagataactttatttcttctttttgcttcatatatatgttaaattacctatggtgctcataaactgcatttacagagcaaaaaaagatattccacaaatataatcaatgtaatcaaaaccacataatggcattgacctgaatttattattttttacatgaggaaaaactgaacacataatatcatttcaaaaacaaaagctgggtggacatcttgaacattcttgtccaaatgccacagtctcaggccctattgccttctgagccaagttgaggtaagtagatatactagaatgctgtggaaactgaggtaatgaaagaagtgatacagtttaaggagacagaacgggcattgtgtagttaattcagcgtgacttgcagacttaacaatgcgataagttcatggtcatggtcacagaaacatgaaagagaaactgagttcagctgacgtacctgaccacatccagtgcacatgaccctcgctttttcctggccatgctggatttcttggagctgacacacttcctcagcagaaaactctctcctcttttagttatccctgagtgaaatgatcctcatctggttcctgcatccttcactgctgtccttaattacaataccctgaccttttatgtataaaactggtcatatgaaatagtagaacccatttatttgtcctttctttgctcttggcgtctctctcttccacaggcctgtgagctctataggaggagggatatcatctctctagttcacagtatctccccacattatagcacaatgcctagagcatggcagtcacagaatgcatacctatgacactgctgagtagaagtagtctcccatagtgctccccagacacagaatatatacctatgacattgctgagtaaaagcagtctcccgtagtgctccccaaacacagaacacatacctatgacactgctgagtagaagcagtctcccatagtgctccccaaacacagaatacatacctatgacactgctgagtagaagcagtctcccatagtgctccccagacacagaatatatacctatgacattgctgagtaaaagcagtctcccatagttctccccagacacagaatacatacctatgacactgctgagtagaagcagtctcccatagtgctccctagacacagaatacatacctatgacagtgctgttgagtagaagcattctcccatagtgctcctcagacacagaatacatacctatcacactgctgagtagaagcagtctcgcatagtgctccccaaacacagaatacatacctatgacactgctgagtagaagcagtctcccatagtgctccccagacacagaatacatacctatgacactgctgagtagaagcagtctcgcatagtgctccccagacacagaatatatacctatgacattgctgagtaaaagcagtctcccatagtgctccccagacacagaatacatacctatgacactgctgagtagaagcagtctcccgtagtgctccccagacacagaatatatacctatgacattgctgagtaaaagtagtctcccgtagtgctccccagacacagaatacatacctatgacactgctgagtagaagcagtctcccatagtgctccccagacacagaatacatacctatgacactgctgagtagaagcagtctcccatagtgctccccagacacagaatatatacctatgacattgctgagtaaaagcagtctcccgtagtactccccagacacagaatatatacctatgacattgctgagtaaaagcagtctcccgtagtgctccccagacacagaatacatacctatgacactgctgagtagaagcagtctcccatagtgctccctagacgcagaatacatacctatgacagtactgttgagtagaagcagtctctcgtagtgctccccagacacagaattcatatctatgacactgctgagtagaagcagtctcccatagttctccccaaacacagaatacatacctatgacactgctgagtagaagcagtctcccatagtgctccccagacacagaatacatacctatcacactgctgaatagaagcagtctcccatagtgctccctagacacagaatacatacctatgacagtactgttgagtagaagcagtctcccatagtgctccccagacacagaatacatacctatcacactgctgttgagtagaagccatctcccatagtgctccccaaattttccattcttcagtcactttcaaaaatataacatttaaaatttacgctctccctctcccctctcccctctcccctctccctctccctctccctctccctctccctctccctctctttccacggtctccctctgatgccgagccgaagctggactgtactgctgcgatctcggctcactgcaacctccctgcctgattctcctgcctcagcctgccgagtgcctgcgattgcaggggcgcaccgccacgcctgactggttttcgtatttttttggtggagacggggtttcgctgtgttggccgggctggtctccagctcctaaccgcgagtgatccgccagcctcggcctcccggaggtgccgggattgcagacggagtctcgttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgagatatggggagctcctctgccccaccgccccgtctgggaggtgaggagcgtctctgcccggccgccaccccgtctgggaagtgaggagcgtctctgcctggccgcccatcgtctgagaagtgaggagcccctctgcctggcagccgccccgtccgggagggaggtgggggggtcagccccccgcccggccagccgccccgtccgggaggtgaggggcgcctctgcccggccgcccctactgggaagtgaggagcccctctgcccggccagccgccccgtccgggaggtgtacccaacagctcattgagaacgggccgggatgacaatggcggttttgtggaatagaaaggcgggaaaggtggggaaaagattgagaaatcggatggttgccgtgtctgtgtagaaagaagtagacatgggagacttttcattttgttctgtactaagataaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccttccactattgtcctatgaccctgccaaatccccctctgcgagaaacacccaagaatgatcaataaaaaaaataaaaataaaaaaaataaaaaaagtaaaaaataaatttacatctcagttttctttcacttagtagcatttttgtatccaatgtctcttgtgtttttgacttcctctgaactattctacaattcttggaagacagaaaattaatattcaagggcaatgttccccacattcaatgtccctgattgatattattcatcgaagactgctacatcatcttttctccctgccataaaacagggttttaaaacaatcgcagatttcacaatattgtcacttggatgaattactatttttcaatgatacttcctggttgataattattgattattgtggtttttgccattaaaagcaatggcaaaaattgcaattactttttcaccaacctaatacttcttcagtcactcaaaaatactgtgctcagggtctcactgattagagtgcatactgggagcagtcaggtcttgtttatgcaatgatctccatttcatgcattcctattaatatcaccaaaggatacaagataataccctgctactttaggggataacagtatagatacatgaaagataaagtttgcattcaatattttattccaaatattttatagagctactacataatgacaaaaaggacaataaggcaggaacatataaataagctaaggtatctaatgtagtcatgagggtgtccacaggggatgttgtgataacagatttaatgtctttgaggacattccattcaacatcagaatatacttttatttcaaagactcatgaatagtcagcaagatagaccatttcacagatcattaaataaaccttaacaaatttaaaagattctaaatcatgtgcaatgttttctctggcaacactgaatcaaattggaagtcaattacacgaaaacaactggaaaaatctgtaactacttggaaattaaacaatatgtttctaaataatccacaggacaaacaggaagtctcaaaggaaaatgttaagaaatttatgaagttttaattctatttttaaattacacgcatatttcattaattatagttgttgtatgtgctatgaaataatttcaggttacctacaaagccttaattctaaatccagctaaagtatcattcaaaaataaaggcagagaacacaagaaattttcagatttctttttttagacaagagtttttaccattgtctgaaggaactattatatttaaagcataaatacacaaaggccaacagtttgggaaagaagataacagcaagaaatttttggaggctgaaaaaaaaataattagaattggacttcttagatctaaaaaagctgaatattaatgtggtcatagaagcagctcagaagcttgcagaattatactagaagaatccctccaaaagcttgaagttgaagtaatcaagtacctctaaacagttcaaataggaggcttgtctaaaatttgtataaaaagctgttagatcctgatccttgtaactacttcatgtaggtgagcagctactcctgccccaaatggtacaaccctagaaatttacttaatggaaatgttgaatgccaggggctctggatcaagaaaaatatgaatgacacaagtacataagtgaaactctgtataaaattaggagaagctgggtgagcactacataaaaactctgtacaaattttgcagcttttctgaatacttaaagttcaacgtaagcattaaaaaattagaataatgttaatatttttggtggggagtgtgtgctgattgggaggagtggcaagagggcttccgtgatggtgatgttctgtcgcttgatgtttagtactaatataatatatattgtaatatatattagtatgtttagtactaatatatgtaatatagctatatgctatattatactatgtgctttattatactacttaatattaaaagggattaaaaaccatttataatgtgcttgtctttcttagaagccctgttgcctctttcattaagtgatgagtcaacttgctccctaaaattcccttaaaatagtccttgacctcaagaaccctgagtagtcactcaggaacactcacacctgctctggtgggacaggtgtcatttgagccttatcaggtatagctggtcctgagtccacctccataaatttcaggtctagaagctgaagaaagctagcacattttccccatcctgggccattggcttctctgacatcagggtcataagactgagggtgaaagtacttgcttatctaggactgtatttaagtaaaaatattaatccatggcaaattatcttatagtttcagatgttcatcttatgagagaaaaacagtgatagcttaataacaaaggttttattatgcaataaaacatttacattcatttagaattataaacaatatttaatgttttaaatgtactttcaagaacaggaaaaaacacatattaagcattcaagtaaaattttatataaaatagttgcaaatagataggtctaagcaaagaattctttctcctgtgttgtagcactttgagtaacttttttccttgttttataaaattaaagcaggacagtttttaagaaagacatttaaagcaataaacatctattacattgataactacaaaagcatagttaaaaatgagaaaaaataattttacaaatttttatttggcagcatatcgaagaattatatttacagaattttatgttttattgtattttcccaattgtttgcaatctctctggaaagtaaaagtgagatttgggatgtaaagtccagtgcctaatggagaggtcagcctcacacacaactgcgatgggctaatgacagttcacacatcaagactcttatcctgaaccaactaagaatatcagtgtttccacgaatcctcttcccatcccatcaagtgaaaatcaggaatagccagtgtacatttcacgagcccagtcacctgagaatggcagacagcccatgtgccaagggactcacgctcaggtgttctgacaaaataatgacaatggcgatgatgataatcaccagcagtgaccaagaactcagacccaggaaagagctctgtatgtattaacacattgaatattaacacaggtgtagaaactgaggcactaaaacccaggaaagagatccgtttctatcaacacattgaatactaacacaaatgcagaaactgaggcactcagtgacaatctcagtagatgcattgatggaaattgtgttaatttcctgacagatttctaaaaataactaagtgaaagagaaatatccttaaaatatttggcaaaatctaaaacatacgttcctgttctaataacccttctgcttgttttatgttcttttttgttgactggctaaatcaggtactaaaactgtgtgcgtgtgtgtgtgtgtgtgtgtgtgtgtgtatgtgtgtgtcctcttccaaaaaattcatactaacaggagtgcaaggctacaggttcaagatgaggtaattaaagcagttcgaacatgtgtggaatgggaaggaataaatcaccacaacaagctgcagttacacaaccttgaaatattttatgaaggtacttttatacttttatacttttagtttttgaagaaacatttgcatttctatctacatatagtagtgcaaatattgtctttctcccattcaacaggttttttttttcaggatttttcatcatttcatcaacaattttttcatctttttttgtcataaagtatttatgcttttttggggttttgttgcagatcttctatagtaaagaccaggatgttctacttttgcagaaaatatatcttcacaaagagtctccacatggctgttttaatctccttattcctaagactatatatgatgggattgaggaagggaggcaaaactgtgtatgtcagagcaatcactaaatcctgaatggacagagcttttgcaattggtcctaaggcagcaaagagccctgtggtaagaaagagcatgatgacaatgagctggggggagcaggtggagaaggcttttgctcgactctgtcctgaagggattctgagcaccgttgagaagatttggaaataggagatcatcatgagaataaagcatcccagaaccaagcatgagctcagggccagggtcaaaaactctacaaagaaaacctcacaggaaaccagggccaacacatgagggatgtcacggaagaactggtggatcacactggatctgcaaacgtgctcccgaaacatgttgccagtgtggacggctgcgtaggaaaagcagcttagccaggtggtgactgccatctgatagcaccctcctgatgtcatcacggctctgtattggagggggtggcaaatggcaacatagcggtcataagacatgacagtaaggaaggccagctcagcagatgcaaaggcagagaaaaaatagacttgagccacacagccaagataagagatggagcttctgcgagtcagggagttacggatggatttaggcacagtgactgagatgtagcacagatccaaaacggagaggttcttcaggaagaagtacatgggtgtgtgaagatgctgatcgagagtgatgactgcaatgatgagcaggttccccaccagcactgccagataaatcagcagaaacagcccggcgtgcagcacctgcagctcccagataccagaaaactccatcagcaggaattctgtcacttttgtgagattgtccatttggcagggaaatctgtgatctgattgttgagaaaaaatatacaatagttttaaatgagacaaaaagtgaacacagtgtggtaggagtaatatcctcctaaattaaattcaatccactggacatcttccacactgcttaaacaaataaaatggtgggagatttttaacatggaaagatcataaaaaatatatgcctaagactatgagttgagtaaccaatttctaaaagcttttgattagtactgtttttctattatatggaacttctcaatcttgaaattaagatttttctcatcaaataatctagggtgcttattaaatatgcagaatttcaagtctcaaggcaaatatactaaataaaaatttgtgggataaaaccaataatttgcttttcatacaagtttctgggtgattttttagtacaaaagtttgtagttttaactgtggttatacatcctgggcagagtcaactgtctttagctatttgttgaataaattgggtggtaagccactttaaaatgaggatttactgtttaagacatggaatgagtatggaatatgattttaaaaccattgataattagctctggtttggagagagggaaatttattttgtgtcaatgtgcaagacatgacaatagttatactaacaatgccattacccatgtgttgcaccttctctgtgcccgatgctattatctctacaggacacaccttggctcaattaatattcataattgtacaataaattaaaatatgccgttattattctttttctcaagataaaacggaggcataacaagatcaaataagttgcccaatgcactgaaagagccagcacctgagccagcatttaaatcaaggcagttcatttccaggatgtgttgctgacctctgcattctaagtttttttcatagaaaataactttgactaacataagctcacaaaaataacttttttctatatattgtttatcatattttgtttattttcactggtattatctatatgtttaaaattagtttttctgcatcaaagtcatgtgtgttagatcctgttcacatgactcaaatattctcactaaaaacaacttattaatttttttcaaactagagccaactttaaacaagtgattttaaaatcaggttactgatcatctaaggtttagttgccttatttcattaatgataaactctattaagcacataaatgctatcccttgctaccaggcaaatgtgaaatgttatttataagacaggtagaacctatgttttatgacaaattttaaagataatgtgaaatgttattttttataggacaggtagaacctatgtttaatgaaaaaatttgaagataatcttttgtccaaatgctataaatgatacagtcactttgaagcatttcattgtatcattaaaacaagtaattgaaaagaattgcactcttggcaaagcgcggtggcgaactcctgtaatcccagcactttcggaggttgaggtaggtggatcacctgaggtgaggagttcgagaccagcctgaccaacatgctgaaatcccgtctctactgaaaatacaaaatagctgagcgtggtggcacatgcctgtaatcccagctactcaggaggttggagcaggagactcgcttgaacctgggaggtggaggtggcagtgagccaagatcgtgccactgcactccagcctgggcaataagggcataactccatctcaaaaaggaaaaacaaaaagaattgtactgtcacacaaagtcaagtgacgagcaatacatatttacaatgaaaatgacaaaggagcactatccctgataaacgacaaactataaaaacacattagcataaacaatgagcaaagtatatgaacaagggctcagaaaactggaaagctaatgacccaataacaattcaaaatgtgttcaactttactagttatggaaatgcaaattaaaactttaacatgatgctattttgtgtccattgctttagaaaacatatgtctggcaagtaaagtctcgacaaacatgtgaagggacgaagctctttgctgctgcttagtttgctgtgtaagcagcctacctactttggagggtcaactggaaattttgaacacaactgaagatgcgcaagtttgatgcagcaatgctccttctcacaaatgtacacttgagttttaaaaaatgacatatgtgaggatgtttgctccatgacgtttaaacccctaattaccatcactaggaaaatggataacataccctactttatcccagaatggaacactctctagaagttaaactgaatgggatactctacatcaatattgaacatttcaacatagttttgaaaaaaccccacaaactattacacaaaatatgttcccagtcatatgcatttaaacattcaaattgtgcagtgcattatttataaatacacacacatacatatatatatatatatatatacacacacacacagataagcttgtataaaacagttactggaatgaatacaaatgccaataaatggggtagcggagggaaaaaataagttgaaaacattgaacagtaattatatctgtaatattttaacagttaagatcattaaagcaaacaaaaatatgaataaatgataagcctaagtgctcgttcttaaaaatcatttgttatactctttctagattttggatatttcatatttttaatattatttatacattaatgtcaaagaagcaactgaaatacttttgtgtgttataaattgcttttatattttatatatttaaattgcttgtaaaattcagtgaaaaaagctctcttttttccactgttttctttgacattatagattaaataaaatacctcacatattaaagtaataatctcaaaaaatatgattaaacattaataaaaaagtaatggggactcaggtgattacattctgcatattttgacatccattataatactatttaacaatgcagagtaacttttaaaactgggtttttgttctgactttttaatagaactcaatgaaacaagtaataaaatggttgttaattggtttgtatttaaaatatctcaaccaaacaaccaagaattgcagctgtcccataaaacaaggcaaaaggttacccacccttccagcagaatcagcagtgtacaggagtatactatctcccgggttagcttgctatcggtagatgtaaaattctacaaaactgccacgtggccaattccttgtaatgtattatctagagaatgagaaaataataatgctctttccttgattctaacactcacatttctgcactgctaaaggaaaagcatcatataatttatatatagttgtgtatatatagtgcatatatagttcgtgtatatatatacatataaatatacatgtatagtatatatatacatatatatgtatagttgtgtatatgtatacatacatatatatgtatatatagttgtgtatatatttgtgtacatatagtgtgtatatatagttactgtttattgaaaagttattaaattaatattttccttgaaaattgtctacaatttgaaattgaggacatacaaaacaaatctatagggatgcaaacatattatcattatgatatataagcatatatacaatacacctattcaaaatattaggcaaattgatgtgcatttattaacaaaaacttagtagttaacacattggttaaaaagacacaatacattttcatatacatatgtgcatcattgatagatataagttgaaaattttgaatatattatttttaaccgtaaagcatattgaattaaatatgtataaagatttcctgcttccaagtctgtctattttaaattcacacatgtggtatgatgagtaataagattaaaagagacctgaattcttgtcatgttctgacacagctgttttaagttggggaacctacaaatacattttaatttcaatttactgaaatgtaaaactacactcaacaagatggcctctgctgccccacctctgagagcatttgtatctaatctatatgaagcctttttacttcagtgtagttttctctgagtggcctgatgctgaagagctgccctttatcccacttatatcaagcaaaagagcaacactgaggaacaaaaccaatacacactgcaccatgagctgcttccactctagtctcaaactaaaaatagatctctccaaaactgattaaaatgataaaaattcaagcaaactgaatgcactattttgtttgcttgtttcattggaaaaaaatatgaaacataattactaagagaacaattaaatcactttaagcaaacatgtcttgatttttttctcataaaaaatttgaaatgattgcttacataaatctcatgtagacaaattcaatttccttattgggtaaatatctgagaaatacaagaccagcaataccttgattaaataacatgtagcttctcaatatgtattcactgtctggaccaatgatgataaagaaacagttctgaagttttcctctgtgtctcaccagaagaagtgacccaatttaacatgcaaactcagtgatagagaaaacctgatgtataatatatcaaggagacaatcttctctgttagtttcccatagagactgggccgccacagtctggaggagattggcttccagaaggaagcctgggggacgctggtctcaggaggatgctgcctcctctgggttaaattgtaaattacctgctgaaacagaaagcagaatatggagtaggtgccaactgaactcagagtccgtgaggaagtgatgagcatgagatatagagattttcattaagagagtgaggagagtaaacagtgaaaaaagtaaaggatttatattttcacatttcataaaataatcttcgataaagtacaaaacccagacatttaagtactcagaaaataataaattgttttacttcatcactatgcctagtcagtatgccacatgagagcagttaagtgcgtatactcagtttactttgcagttacagcagcctgtttctgtattgcacatagactctcagaaaattattggcttaatggagacaatcatcatgcttctcatcttcctccaaatctatttgttccacaaccagtcacagaccaagaggatgggtagatctcactaaatacgatcatttgaaaattagaagtgaatagaaaaatctggcagaaatttaggagatatatattttatcatttcatttttcaaatgaggaaagtgagtcttaatataaaaacttaagacaaattaaacttagcagactttatttgatcaaagaatgattcattatcagatcgcactacagatcagaagaaattcagagagctctgcccagcagtgtgaacaagcttttatgggccagacataggagcaaagtagaaaaatcacctgcttgcctacagctagacatccgtcttgtttgaacatggtgttatttaattttggcaatactataaggcagtagaaaaatattgcacatatgtacatacatccagatatagatagacatgtaacagaaacattacaaatttttagccatgtgccaggtacaataatacaaatctcactaatttattaaagaatatctggatctaaattgtttttggctaatgccacttaaatggctaaagcttcttactaatatttgtgaaaaagatcattaatgtttttttatttgctcagtttccaaatatctatttttcttacttctacttctgatgagttatctaccctaaacttgcattttaaatagatacctattaaactctagagaagactgtgtagaaaatttatatctcaaaagcacagagcttggacttccagcttaaatgctttaatttgcccaaaccaagaaagaaagatgtaaagacccagttagggcaagacagctaggaaaagcactttaaaggcaaggcttctgtagatttaagccaacgctttcttccttatcagagtttccagtgttctctgtccagagaggtagaccttcttacaaatggagattccctttagggatgtaaatttctcttacaaagagtcctcaaaataagcaggtgaaaatagtttttctgccaaaaagttgtattttggagatttattctgctaaatcagtggttttccaacccaccttctgtcttttaactaaaatactaagtgggtggaacccactgaagactagaacaaatattttgtgtgcctgactcaccatggttacttctaatcttgctctataatcacagactggtacaacttttctctcctgttttgttttcaagattgcaagactgaataatatttccccccacccaccagaaagagtttggggcatagcaaagatcatgacaacaagaaagaattggcagagtatgtgtttagcgggaagtttcataagaggtgtttcagttgactgcagggttcccatgggagaagcaggattaaagagagaaaacagaaaagactcattcttacaaatgtttttctaaatatgattcaactgtcagtcagatagcttcaggtatggggacttccacatttgatttgaaacttccattttttttctctgggggattggttgattattgcccagggagtgtagcccttgggggctttctctagtaggtagacaggccaggtccatcagatgactggtatagaaatgaaaaatttcttatgcaaaggcctgactatttaaaatacaggtaaacttcttgggacacgcggtcctttacttttgaggcaactcctctggggttcaaaatagctacaaggaggtcttctcagtccccatagctggcgtattataaaggcatgcacctctttgtcctttgtaaaaagtctccccactgtggcctttgtaacttaaaattacctttggtcaggttcactcatttttctagaaaaacacatgttctgggtccatggttcttatacataaaatatgctgcagtcccacatggaagagttctagagcccttggattcaaaaaacacatgatatgctgtcttccaggaaccttacctaccagaggcctcctactggacccagtctggtttctttaccagatccattccaattctgaacccagtccagtcaacaaattgctcaaacaaagttagagctcaaaacataaatttgcagagtttgaatccaagaggaaatttacccataatcttcagttgcagcgtgagagcaatgggccctagtgggtatctacacttgggcattccttgttccggggggccactgggtatccttcaaatcttacttctaacaccaaatagttaaaagaaaaactttaccaatgagacagaaaattaacaggcctattcaggacttgaactcagctctggaccaagcaaacctaatagacgtctacagaactctctacctcaaatcaacagaatatacattcttctcagcaccacatagcacttattctaaagttgaccacataattggaactaaaacattcctcagcaaaggcaaaacaatggaaatcataacaaacagtctttcagaccacagtgcaccaaattagaactcaggattaagaaactcactcagcaccacacaactacatggaaactgaacaacctgctcctgaatgactactaggtaactaacaaaattaaggcagaaataaataagatatttgaaaccaatgagaacaaagacacaacacaccagaatttccgggacacagctaaagcagtgtttagagggaaatttatagcattacatggccacatcagaaagcaggaaagatctaaaatcgacaccctaacatcaaaattaaaagaactagagaagcaagagcaaataaattcgaaagctagcagaagacaagaaataactaaaatcagagtagaactgaaggaaatagagaaacaaagaagccttcaaaaaaacaatgaaatcaggagctggttttttgaaaagactaacaaaatagatagaccaccaagctaggctaataaagaagcaaagagagaagaatcaaatagacataataaaaaatggtaaaggggatatcaccactgatccaacacaaatataaactaccatcagagaatactataaacatctctatgaaaataaactagaaaatctagaagaaacggataaattcctggacacatacaccctcccaagactataccaggaagaagtcgaatccctcaatagaccagtaacaagttctgaaatccaggcagtaattaatggtctaccaaccaaaaaaaaaaaaaaaaaaaaaaagcccaggaacagacggattcacagaggtacaaagactagctggtacagttccttttgaaactattccaaacaacagaaaaagaggaactgttccctaactcattttatgaggccagcatcaccctgataccataacctggcagagacacaaccaaaaaaaaaaaaagaaagaaaatttcacaccaatatcgctgatgaacactgatgtgaaaatcctcaataaaatactggcaaactgaatccagcagcacatcaaaaagattatccatcacgatcaagtaggcttcatccctgggatgcaaggctggtacaacacatgcaaatcaataaacacaatccatcacataaacagaaccaatgacaaaaaccacatgattatctcaatagatgcagaaaaggccttttttaaggctgagtaatatttcatcttaggtagatatcacattttctttatccatttatcccttgatggatatttaggttgcttccaaaaagaattagagcttctgcagctgccagaaagtaagccatcaaaacagcagttgggtaacaggaagaattctaacactcttgagctcataggtagaagggacccttcattcattcaacacacactaacaatgcatttatgtcccaggtacagtgctaaaggctggaagtatgtggatcatgcatacatacacagtccctgtcctttcaaagtgttcagtctcaaggaggtgtgagtatgttagaaaatattctgaggtgccagaattgcactagatgcattgatgacttggagggtattggtagggtagaatgttcccgtcagagaattaagtatataggtaccctttcctcaaaaatgcttagactaggtagggaagagggtgaggcacaatagcatatctttaattgggtggggtgagaaccaaagaatcggaaaaacagacattccagctcctccaagttcttccaatcgtcagaactgtggaactagcccaccaggctttctccagtcacgtgagccgggagccaccaggatctcattggccaaggctcccagagggcgggaagagcgggaagtgaggaccaatggggcaggccaaagggactgtggaggccgacgcatgcgcagtgccctccggcctagcccggccaacccgcctgtcccggaccgcccggcgtcaggtacgggttcaccaagccaccccgcccacctcaggacgcagctgccggtccagctgctcccgcgggcccacagcgcgctgtggaaaggagcggacaggccagaggctctctcgggcctacaagtctctaggctaggcagtgtttccgagtcccaggtgcctccagaggccgagctcacagcgcggcccacccagcatccgggggcgctgtgaggggcgctcgcccagcagcggaaaggccattcgcgtggcgcgggagcgcgggcccggccgcctgggcgtgtccctttcgcggaactgagctcactggctcctctcttccagacggagcgacggggccggccgcagcctcagccacgcgtccctcggtggcgggcaggctcctcttggcctgcagccttactttcatgcccttcttcacaggtgagcggatggcttggggtcctcccgcatttcccgcagcgtcgctctctgcattcccgcattcccaggttcctgctgcattcgtgaattccctcctgcattcctgtactctccactcttccagcctgcattcccacatttccaccctcattcctgcattcccaactgcatcccccaacgttgccactttctccccatcgttcccacctgcgtttccgcattcccacatccctgctctgattcccacccgcatttctgaatccccacctgctttctctaccccagtccagcctttattccggcatttctgccttcattctcgcgttcccagccacattcccctttgcattctgcagacctccaatcacctttctttgttgggcagtgtactcatcagcacggcataaggaaagagcagacacggctcctgccctcataatgcttacagtctacagaacagtgctggggacacagtcctgagtgttgccttctgatcaaccacttaactgactgcctggcctcaggaaagcagctgagcttatctgttcttaggtatccttattagagtactaagaatattggttcctgcctattatagttgtaaggaacatgtgagctagtaaagggctgacacaatgcctggcatgtaataagctctcattaaagagagctttaatgtttgtctgtctttctccagagaccacttcatgttgggagaattgtggggagagaaaatgttcaccagtgaaacgtgaatcatgagccctcatccaagtagttctacttccccgatttccctgaaggttatagggtactgtgtgagcagcctctaactctccctggttgttcacagaagtaagatgttctgggtctgcttatcgggaggagtcattcagttagtgccacataatcattttaacatttctcccattgctgccagggcatcctgcatcacctcccaagccagcctcccacgtcacctgggtggtgtactaattcacggccaggagcactgactgttcctgctcccacgtcacctgggtggtgtactgattcacggccaggagcattgactattcctggccacctccttgcacctttcctggttccctcagcctctcaaagttctcatctttcctttgatgagaaagagaagggcagactgaaaatagactcaccacccacctgtcctttccccctgccccatactggtggaccagcatcacagtaaaaatagttaccacttagtaagaattcattatgagccaacttaggatttttgataagataaaagagttcagcataattttacataaaattagttttttcttgatatattttcttctcttctgctttccacacctaataaaacattacagaaagtcttgttttatttattttgaggacaggccttaggtaaaatgtggaagtttatcttggagcttccaatcttcaagttctcttctcctttccccatcctctgtcttctccactctatcctatcttatctcctctagagcccaaacccagccccactgatttttctcaatcaaagctcatttaaaaaaaaaaaaaggatgggaaaatcgtcgttcctctcactatgaatagctaagaacagtgctattaacttgcctggtatgctctgcattttaacagaaatcaaagtccagaactttttaaaaaaaaaaaaaaaaaccatttactggaatattgggcttaagagtgtttgtgcatttggttgagagggcaggaagacctatcagtctgcatgtggcacacactctaataattttcttcaagttcacatgccattgccttgggacatcagggccccagccaggcactggaggggcagagggaggcatgtgggcaactttgaggggagtgggagaaagtgatacttaatctcatacttaaccaggtgaccacttgtttcctcaaaagtgccctcctttgctctgctgatcagagattgcttagtggttatgattagtagtgaagtttgtttgaatataatattttctgtaacaagccttttttttcgggagcaaaaacaaattttaaaactttttttcatatattgtcccattttaaaaatttacttacatttgtttttaattgtgtaactgtaaaaataaataatatatgcctatgacgtatattatcctaccctcttcagcccccaacacaactcctgtttagcaaccatagttattcctttcttgtttacctttccagaaatggtctgttacttacaaacatatccaaatgcatcttttctttccattggcagcattttatatcaaatgctctacatcttgtttttttccccttaaaagtacatcttgaagagcttttcatttcatcagaatatggccatattctgtctatggtggtattcatctctgtttcatggatatgacagaatctatctaaccatgagaatttcagtcacttctgatcacttcttatcacagaggatgctacaatgaatgaccttgtacaaatgcatgtaggaaaatacctaggaattgctggataaaagagcttgtgcaaattgttctcaaaaagaagtattactaatttacccaccagaaatagatgagaatacctgttgcccctcattgcaattttaatttacattcatcattaccttctgcagtgatcaaaatgtctatgcctgtgctgtccagtacagtggccactagccatgtgtggctatccagcatttgaaatgagactggtgtgactaaggaactgaatttttaattacattttattttaattaattttaaatagatacattggacagagtagcttcagagcagagtagggtatgaaagagtttggaaagagacaaaaggggatatgagacatattgctgagaaattatgaattggaaggtctctctaacgttaaccattgaaattttcgttattttgtcttttaattttcaaaattactttttaaagtgataagtttttacgaattacttttgaatgtatgctttttttttttttttttttttttgagagggagtctcgctctgtcgcccgggctggagtgcagtggtgcaatctcggctcactgcaagctctgcctcccaggttcacgtcattctcctgcctcagcctcccgagtagctgggactacaggcgcccgccaccacgcccagctaattttttgtgtttttagtagagacggggtttcaacgtgttagccaggatggtctcgatcacctgacctcgtgatccacctgcgtctgcctcccaaagtgctggtattacaggtgtgagccactgcgcccggccgaatctatgcgtttttaaaattacatttggattgtgcttcctcaaacaagactctccagagaaagcaagcctggttagccctggatctctaatggttgtagtggtggagaggcatgtgggcgtctctagtctctgcttctccttctcttcatggcagcacccagctcccaggcctcagcactgccttcccaaccccttctcctaccccgggtggagggccagctgccctcacatttgcagggcccatggtaatatgtcacaatacttaaaagaaatacagtaagctaaaaacaataataaaatattttccatccttttacttacacaaatgtgtcctcagaatgacctaaaaggtttggaatgttcgcaagagtttcatgccagagaattgcagcactgagaaatctggatcctggtctccagcccatctcctttccccattccacactccccttcaactgtgaaggccatcgcgatcatgtgtgtggacacgccaatgctgaagtttaaactccccactcccaccacctctgacaactgctaggttagatctcagtctgtttgagcaagaaatcccaggattcttggtagccaggcaaagtggggaaagggcatacaggatctgggtgggcatgtccccttggtgtcacatactactcatcccataggggctaacagaggcagaagaggccctggtctgggggaggtgaacaaatcaaaactaccttttgatagcctaaggagaattcttcagggaaataccatggcttttactccttttttccccttgctcttaattttccacagatttccacctctttattcatagtccccaccattctctgctctgtgcctggacatcttttactggaacagccaagcccagtctttgcccatgacagcaggtggcagcaagaacacttgaatggaagcggggaatcagtcgacttctgttcactaggacattattatggagccccagaggcagatagtgcagaagaagctaaggctctttcttgttagggccccttctttgagtatcctgtgcattctgccacccgtgacctttacttgtaagaccacatttttctgtgtaagtgtttggaagtagacctttttcaggcctccactcaaaaaatgtccctttttctgtgaggcctttcctgaccaaccccgtgaattatccctaccctgcacatcctgtcctgttttgtctctctccgtagtatttatcatcatctgacatatcatatttttttcttctttgtttttttctgcttcctccatctgaaaatgagctccataatggcagggatttttatagtaactctagtgttattggatgcgtttgaaagtgtcacatgaggaaggcaggggtgaggattagggaagggtgaatggggtgggtggatctagttctagcggctgttctatgagaatgagtacatttgcttgtcaatggcaaataactagccagtcttctatctttttttaacagtctcctgggagattaagatgagtgatctagaggaggaagatgttgatgaattcagctccagtggttttaagtgcccaacatgctttgcagtgcaaggaaggaaatgcgatacagaactcaaatggtgtgcagcagataaaataaagtgtattgaattctctggcatcataaacacaggtacttttctaggatgtactggtattctctcacaagcttatggggtatgtgttccaagggtagggttgaggagaaatcagcttttgtccaaatctcttagaaatgaggacacagcagtggtctgactctgtaaatatgtccaactggctttcacattcacttatttttgaattgatacatgtattcattgacaggctctctactagctttgaggaagttggttcagcatattggaggaatcttcatcttctgcaaattttggttaggtttaaaaaaaaaaaaaaaaaaaaaacatggccgggcgcggtagctcatgcctgtaatcccagcactttgggaggctgaggcgggcagatcacttgaggtcgggagttcaagaccagcctgaccaacatggagaaaccccgtccctactaaaaatacaaaattggccggagtggtggcacatgcctgtaatcccagctactcgggagactgaggcaggagaatcacttgaacccaggaggcggaggttgtggtgagccgagattgctccactgcactccagcctgggcaacaagagcaaaactccatctcaaaaaaacaaaaaacaaaaaaccacgggggcaatgtgtgcttttttcctctgttgttgttgttgaaattttcaaaataagagctctggagagaggcaatgaccaagcttaaactttcttcaaaaagattgcaaattatattttactatgcttgctttaagaaaatacaatacaaaattctaaattaattgaagacatttaaatgagaaatgatttaggagtgatagtgtggaatagcacgaaatgcagtgggctgagttccgtgagggttgggttgtttccataattcctctttacctgctcacttcctcctgctgacgctggggagctccaccttcctgaagttcatctaagtgaggtaattagaaggctaaccatgttggttggtctcttggattcttatgtttctactttctgtaatttgcataataaaagagatgtatttgctttaaaatagcaatcactcgattgctattgacactgcagaagaagtaagatgaaatcatcgagagcgtagaatatgtgccatgtgaaagaatatgtctgaaggtgctttgaaaggcagggaacacaatcacagtcgtagcttttttatggctattgctagttcttaaatgataactcagaccaagaataagagattagatttatgttcctaaatttacaaagagtctacataactgaaacacagacataccccctcccctgagtatcagtagcatacaggatacccctaacaaagtcattaggacttcttactaccattggcataaagggtctataaaagcatatgctatctcaagtggtaatgtaagttggaaaaaagttcatataaagtttagaaaatatgccaatatgtgattgacatagattttgagaagatttaggaatttggaagtcccatctttggaggacacatttctagctcattgcctctgctgcagagagccctgtcagatggatcacaccagagtgtgacttgacttatatcctactccagcccagtctgtatgagtaaaatgcagagtataaggaaggaggaggagagtggaagtctcacttacagtttcttgcaggtattcgtgacgtagccattgaaatgaagagatgcacacaagcagacctatgcaaagagacgataacttcttagatgggttttccaattgctaacaagagtagaaattgcaaatcagccatcagaaatggggccagaatcagacccccatctcccatcttctttgttcttttcctggggagggtacttcatggagctctggcaagagcctagccacttccatttatgaattaaacctgaatttttttgttaatgtattctttcatgagtgttaatttctccatagttatattcagttgtccatttgtttactcattcaatgagtttacttgttgtgtatccagccttgcataaagtgtgttagggtcaaagtgaatcagctttgggtccctgcctttaaggtcccaaagcatttagagaatgaggacgtgtgcagttaaaatgctgagaaagcaatttaagaagaacataaaagagcagaagcactctgcttaaggagcctgagggattggtttggacatagggtaaaagtagaagactgtgggtttgattaaggaaagattgggattttagatggactttgaggagacctttactatatggcagcagaaataacatgcactgagacatggacatggggagatgggtggaggctaagatgcagtagctgaaattaatggtaggaggagtgggggagaggaaaatgtcagcaagtatatgggcctggctggaagcatctttctgagagggatggaaagtgctgccctggatgaacacagtggactcactgagctgaggacaggccagctctgtgatggaaaacagtttccttcaatccaccagagagatgatcaaaagccaaggtccctggttctcactgctgactactttttgttttgtttgtttgtttgtttgttttgagacagagtctcgctctatcgcccaggctggagtgcagtggcgcaatctcggctcactgcaagctctgcctcctgggtcaagcaattctcctgcctcagcctcccaagtagctgggactacaggcacgtgccaccacgcccagctaattttttatatttttattagagatggggtttcaccatgatgttagccaggatggtcttgatctcctgacctcgtgatccgcctgccttggcctcccaaagtgctgggatttcaggcctgagccaccgcgtccggcccactgctgactacttagtacagaatcacccaggagctttaaattagaatgcgcatcctaggccccctgccagaaattcagattcagctgatttgggatgagcctggccttgctcccgcatttttgtcctttgtgttgttttaaatgctccccaaccagggtgactttaattttcagctactattttttaaaataactgaagtataagtaaaagatcataatttattttacccaaagtgaaagacctccaattaaagccaaccaactatagcgtgtaaaacagaagattgtttacatgatatcaaatgtcaattgatataaagtttgaaaaattgcaagtactcttctttagctttagattagttgtgcaatacaagaacactaaccaaattaatggcttttcttctcaaaggacttcctaatttatggagaaatgtcattcatgaccccgaaaatcaaactcatggcataaatacattttaatcctttatgtctctcaaagaaaaaaattccaactaaatgtgattatatttgtttctgtcatgacaacttgtactccagatgtattaagtcaactatcaggttttattggaatttttaaacaagaggcaaatgcatttatttatagctttgttctcctgaaaatttttattctcagttttctcaaacactctatgaaaagtgtcatggatagagtttttttaaatcattgagttcatatgcgtcagtgccataaatcgtcaccagtttatggaataattatataaaagagaagatagtgaatttaatgaacttgtgttctttgccaatgctcattgggtgaatcatggaaaatttttacaaagatttactatattattaactcgaattcccagttttattcaaacagaaggaatacttgccaaccatttaataatcaaagaccaaaatgggcaatgtaatttatgttttctcgttgatgctacatttcacacatgagctaagatttagcctccaatcaaaggaaaagcttatttgtaaacttggtaaaaagatatgacactatattgaaatagaaactttttacaagacaaacaataatgattttacacacttttaactttttttttttgagacggagtctctctctatcacccaggctggagtgcagtggcaccatctcggctcactgcaacctctgccttatgggttcaagcgattctcctgcctcagcctcccaagtagctgggattacaggtgcctgccaccacatccggctaatttttgtattttttaagtagagacggggtttcaccatgttggccatgctggtctcaaactccggacctcaagtgatccatccacctcagtctcccaaagggctgggattacaggcgtgagccactgcacatacttttaactttttaataataggcagaagattttgattgtcatcaacattgttatgtaaagtggctgtaaaaactataaaaacattaaaacactcttggtatttataaatttagggttgattttcaatttttgtgataactttcattatgatgttcataatactgagtggacacagagttagtgaaattacttaatttggatgaatttagttttgaaattgatacgaagtgataggattcacttcaaatgaaatcaagagagcgatatcaccaagatgacagagtaggacatactggccttcattccccttgctcccctgcacccctccaaaaatagctatccacaaatcaacatggcactgacaggtctcaaagaccctgtgttagtctgttcttgcactgctataaagaactacctgagactgagtaatttataaagaaaagaagtttaattggctcacggttctgcaggctgtacaggaagcatggctggggggcctcaggaaacttacaatcacggtggaaggtgaaggggaagcaggcatgtctttcatggctggagcaggaggaggagagcaaacgggaaggtgctacacatttttaaacaaccagatctcatgagaattcacccactatcatgagaacaacaagggagaaatccacccccatgatcctggtcacctcacaccaggcccctcctcacattgaaaaatacaatcatcctttctcaacggtcccccaagtcttaactcatttcaggattaactcaaaagtccacaatccaaagtcttatctgaggcaagaaagttccttccacctatgagcctgtaatatcaaaaaacaattagttacttccaagatacaaaggggtacaggcattagctaaatactctcattccaaaagggagaaattggccaaaacaaagggactacactctacacaagtgctccctcactggtaattaagaagaaattctatctatttattgtccctcttttctcacattccacatcaagcccattaaaaaatcctgctgtatctactttcagagtatctttagaattctacttttttttgcctttcccactgccaccacctcgatccaagcctcatctctcactgtagtattgccatagcccttctgttctcccagcttccagccttagtcccctagagcctactctcatctcagcaaccaggttcatgtcatatggtgtactgcctctgctcaaaatcctccagtgtcacccacctcactcagagcaaatgccaaagccagaatgatgtgggcctgctgttctcctagtgctctgctgcttgctcaccttcttggttatcctcctactcatcttcttgttcttcttcttgctcacctccttgctcactctcattgcttatctacttgttctcctccttgcttaccttcttgctattctgcatgctttctgttcttgctcaccctcctttctcacctccttattctcccccttgctcacctccttgcttacctccttactctccttactcatctccttgcttacctccttactctcgttgcacacctccttgctcattctcattgcttacctccttgcatgttctcctggatcacctccttgctcaactcactgttcttttccttgcttatctcccatcttcacctccttgttctcctccttactcacctccttgcttatctccttactcttttgcccacttttctttctctcctccttgctcaccttcgtcctcttcttcttgctgtcctccatgctctccttcttgctttctctctttgctcttttccttactcacctcccagctgtcctccttgctcactacactccagccccagttgatctttttgccattccttgagcagccacactcccactcaaagcctttgcactgggtttttcctcttcctgaatcgctcttcccctacatatccatgaggtttcctccttttctctctcctaccctttcttcaggcattcactaaaaagtcactctttcagtgagaccttccatgatcactctactgaaaatattaactccatcttccaacagcctttcatatttccttccctactttatgttttcttcttagcattatgcaacctaacattatacttatctaatttactacacattatacttacctaatttaccacccatctgcccaactggaatgaaagctgtacaaagacagggatgttcatctgctttgttcactatcttatccccaacactagaataggacctgccatatagcatgagctcaagaatatcggttgcactgaaggatgaatgcatgaaaaggtggatggatgaataaacaatggaaaaagaaacttgacttaattagtagctacattatgaataaccacaagatggagacattcattaataaaatgttatccctctgtttttttgtttgtttatctgcttcttcctgtctgtatttgtgtgtcttgtttacctctgtttcgcactatctgttcatatctgtatggggcatgtgtgtgtcttttcttcccttttttattttgtgtcatttcttgtagagttggttatatttttctttctctgtccatgtagtctgcatttggcaatacaaaataaaagtcagcactgaaatttattttgccaaggttaaggatgcatccaggagacaggtctgtacttatctccaaagatgattgtgagggcttcaaaatttaaagggggaaagacagatactggggaaagaggaaaaaatgttttaaagtgtgggtaaataggaggcaagcagtggcatgctttcgagtctttgataagcccttcacttgtgagaagtaggtagaggaatagtcacttatgcattcatctggctcaattaatctgcatttttatataatataaacataaggcagaatgttggggtgatcagacccaacaccaggtcacgggagtgagaaagtctggcagagtcaaaggactgagaaaaagacagttggagaagtaaagtgggaccacgggaccatcacaattgtggaggctgtgaaggcccggagctctgggagcccagtgctatttattggtaatccagcaaagaaacaggtggtaagaatgtggaggctgaaagggcgtgttgcattaagcacatgatttacagctgtgatggtttagcatctgctctgctacttgagaaaatggagagcaggttcttttaactcaaggtactgttgatcctgggagggcaaggagcaaggagcaaggagccagcaagtctagacacattccagagctgcgagccctggattctgtccaagccatgagggattttatgccctgggcttagattatggtgcatcagggtagccttccacccattagcacagagcttggtgttccaaagaccacaaggggatttagaccctgaaccctggacatgttccagagctcttttacgttatgtcagatatgcaagccccacctcagcttctcccaacactcagcttttcccaacacagaggaagaaatctgatatgcatttgtctcaggtgggcagaagaatgactttgaattctgccctttgtcccatacctgtgaagatacactatcaatttacattttcaggctaaaattcagcagaactattttagggtaaaggaatttcctaatgtacaaattgtgaaggaggtatgtagcttttcttttcttttttttttttaatctttgaggttatcttatttaggaataaaatgggaaacaaatttccctgatgcagttcccagcttgacttttcgcttttgcttagtgagcccggagtcctgagatttattttcctttcacagttcccatgtcaaagttggacatggatttgctggagtggaggcaagaggcacagataccaaaggacctttggggctgagtgttggatgggtcatctacacagatttgaaagggggcaggcctggggttgggagagcaccatgcttttgtcttagagacctgacctctgagaaggatcgtcattgacccgaactggggtctgcccacccagctggtaagaccagatatatacactgaggtttgcagcagtaaaaaggaaggcagttatttgcagagcaccaagcaaggaggaccaggaagctaatgcttaaatcctgacctctgaggtggcttgcaggtaatggtttttaaaagcggggtaggccagcgcggtggctcacgcctgtaatcccagcactttgggaggccaaggtgggcagatcagctgaggccgggagttcaagaccagcctgaccaccatggagataccccatccttactaaaaatacaaaatcagctgggtgtggtggcagagccagctgtggtggcggcgcctgcaatcccagctactcaggaggaggctgaggcaggaaatcacttgaacctgggaggtggaggttgcagtgagcagagatcgcaccattgaggcggacgttgcggtgagccggggtcatatcattgcactccaccctgggcaacaagagcgaaacaccattaaaaaaaaaagaaaaaaaaaagcaggggtaaatttcaggaaagctacaggcaaagttgtaaatcaatcctggaggttacacattggttttgacctaaacgggtgggatatcttgaagtggggcttacaggtcggggtagattctaagattttctgatttgcaatggttaaagagttttgtttaaaaatcaaacaaaaaagaatattagtgctggctcatgggtatgaccttctccaggcccctcagaaagaaatttctaatggcaatcacagttcagtccttagttctcccttatctgaggtctgtgtgtctgcagttccattttgtggggctccaggtttctgaaaactagctcaggaacatatgttaagatattatctttaatttctatggggagccaaacatcttctggctctagtttctttggctattgttttaaactactattaccttcttgcttatcaaattgttcatttacttttctaagctagctaggtgcctggaattttccttgaaggtactcaagaatttcttttatgtccatgcctgggggacccagagacccctaagaggggtccctgctctgtctcaggatccaagagccagagcaatgaggagccagaaattagctgcggtcatcagcctctgtctgtggaaagcgaagaacagcctctacctgagattacgacagggaaaatcgttcctcccttcatctttaagcccctcaagcacgctgcattatgttcagttacctggagcaatggtctacattatatttcgtactcttttctgcaggaggcaacagaagattggttctgcatttttgtcaaatttcttgtagggccaagcgcagtgtggctcacacctgttatcccaatgctttgggaagccgaggcaggaggatcacttgaggccaggagtttgagaccagcctgggcaacatagacaccctgtctctaccaaaaacataaaaataaaaaattagtcaggcatcatggcgtgtgcctgaaatcctagctacttgggagactgaaacaggaggatcgtttgagcccaggaatttgagtttacagtaagctatgattgtaccactgcaccccagcctaagcaacagaatgagaccctgtctttaaaaaaaaaaaaaatctagtaggacatcatccataatgttcagagttccatataaaaagattcctataatctctctcaaaagtttgttctgttgatgatctaaacttgctttgtgtgtgctaattccctctcaaagacagccacagccataaattagtttcctggtacagtgaccctccccttcacccattgtataacacagctttgtaatattttccttagtgtaacagttccaatagtcctcatttatagataccttttgttgacaaaaaatatatatttgaagagattttattctgagtcaaatgtgagggccatgactcatgatgcaacttcagaaggtcctgagaacacgtgcccaagatgcgtgggttacagcttcattttacatattttaaggagacctaagacatcaatcaatacatgtgacatatacattggttcagtcctaaatggtgggacaactcaaaacggggctcacgggtcacaggtggcttcaaagattttctgattggccgttggttgaaagagttatgttattatctaaagacctggaatcactagaaaggcgtgtctaggttaacataaggggttgtggagaccaaggttctcattatgtacagaaagcctcaaaggtggctgcccttggaggcaagaggtggcatctttaacacatgtgatgctgatacttagttggtgcttgttaatttttgttggtgaatgattcttattcttgatctaagatggcaattttctgttatttgaggctttctatgtaactcttcaaacatggaaaacaacatggagtactatgtgatgatagatttcaactttaggggcaacatttattgattttagacttttaatagaaatcagctgtcaaaaaattagctgggcatggtggcggatgcctgtaatcccagctactcaggaggctgagaatcgctggaacctgggaggcagaggttgcagtgagcccagttcgcgtcacggcactccagcctggacaagagcgaaactccatctcttaaaaaacaacaacaacaacaacaacaacaaacagaaagaaagagatcacctgtcaaaccccaaagactaatgaggcaatgtgccatagtcaacataaagtttttatttcagctagaactactgagatgaacaggtcatgtagaatcggccacactcctcatctcctcaaatgctggagcatcttctgtccctagaaatgtgtgcggacaagagattacaggcttgttttttattcattatcaccctcccaaacgtaaagcaataggcaactattctgcaacttctcctcagtcactggttcccaactcagcacaaaaaagcactttcaaaattccattttctgacctgaagtttcaccaattgggtgtccccagtctttgaattttcacctcctctaaacattcctgattgttgtgtagaaatagaatatattcggcagctcatgtacccaacttttacacatgtggatagactaacagaagcatgtaaactaagcattattggttgttatgactgaatgttgcccctaaaaatgtatatattgaagacctaacccccagtacctccagatgtgactgtgcttgtgttactggaaggagggtcttgagtgagttgtctgggtccttggcgttttgaacaaagaattggacaaaatgcacaaagtaacaaaggaatgaaacacaggaatgaagtagcaaacgcagggattaaagtgagaaagcactccgcagggtgggagcgggtcccagcaagccactcaaggacccagttacaaggttttctgggcttcaagtacttcttttgaggttcctatgggtaaccccttatctggatgaaggatttggtctgtggctgaggctgaggtgaactggcaacctgtgcagatgcagggatggtccctgcttggccctcaggcagttcaaggcactctccctttcgctgtgagccttggtggagtggggaggtggtaaggagagtagcctttgagcctttgttatcggtgtgggaagatggggtttttcctttgggtttagctgtaggaagtttaagttaattggccttagggtccctgcccccagacacaggtgttttccttttgatccagctttatgaaattatcacgaatcggcctcatattccctgcccccagaccttggtgttttctcttttaggaagttagcacaaattggcctcagattccttgcctctagaccttggagattttccttgatttggcatgaattggccttaagttccctgcctccagaccctatttattctcctgcccccagaccctattctcctgcctcatttggagatagggtctttacagggtaattaagttacagtgaggttattagtgtgggccctaattcaatatgtcgacaaaaaaattatgaatgttgttatgttgttttcataaacgtttgtgtacaagtttttgcgtttacatgttttcagatatctggggtatatacctagaagtggaacttctgaataagatggtagctctgtttaactttttgtaaaattgccagtgttttacaaagtagctgcactattttatatttccattagtgtgcagggggttttgcatttctccacaccctcaccagcatttgttattgtctttttccttgtagccatcccagtattgggccccaggacaagatgtgctctggtggtggctccagtcccattcctgaacgtgccatgctgcagcaacctgggtcctgggccactgggggaacccagcataaattctttctctggaataataaagtcatatggactctaggcagcaccctctactgcacttagggactgtgagcaaccttgggctgtgaggtatgaagtatcatctcgttgtgggtttttttttttttttaagacagggtctcactctgtcacccaagctggagtgcagtggtgcaatcagctcactgtaacctcaatctcttgggttcaagcggtcctcctgcctcagcctcccaaatagctgggcctacaggcacacgccaccattcctggctaatctcattgtggttttgatttgcatttccgtggtggctaatgatgttgagcatattttcatgggatttctggccatttgtatattttctttggaaacgttaacagtcttttgttacctttcctttttacttttaatggctaaacacaatcttttccctttttaagctatttaagaaaagcaacaccttaaaataatacaacaacaattagatgaaactgaggtccagataactctcctttgctgattctattctttgtactcagaagtgccagtgttcatgaagacctgtagtccccacatgatgagaggcaaaaacatgagaattattagtttaggtcacattgtacactgagttttgtggtgggtggtttttatcttatttagggaagtttaaaacaatcttatttagggaagttttctcttatttagggaagtttattttatttaggaatgtttaaaaaagtttaaaacaattagggaagtttaaaactacatatttcatcctactgacagagttaagcttgcttcatctgcctagtgtcctgaagaaatttcacaagaggttacgagaaaatgtagtttcaaaaccagcaacggcagcaatatccacagccggttatggagattttaagcttttgtttgaaaaccagtttctaaaaatgaatccagttgcaatagcgtatgtattttaaagagaatgataattatatagggcagtagaagaaaagctggaaaaagaacacaacaaacttgaatgttgatgcaatttcatgctgctcttcatttatatctttgtatcttataaagataaaatagggagatataaatagggaatcaaaaatgtacatagttgagtgaaaattaagcataagcacaattatttaatgtgtagagtttgtgtttgagattgtgaaaatgtttcagagatgaatagtagaggtggttacacaacgtggtgaatgtacttaatgacactaagttatacacttgaaaatggtttcaatggcaaattttatgctatgtatattttgccacaataaaaaggttttttaagagtcagtagctcaaaagaagacagagagatcaaatggctagagatgcctagcactcaccttctccacaaagaaggaccaaagtaacaaattgataaacacacattgactagaatgtctaaggaagaacactggaattcagcagatagtgttcaaattcaaagaaaagaaactttgaggcacaaaaactcaggatgacagcatagagaggtaagcaatgcagcctaccgagatgtgcttggagccaggagggactccctccccattgcggagaaaaggttagcaggaggtccccagaagtctatatttccaccagacacctgcagtcatagctacaggagagccctcagccctcacagtcccttagtctagtatagggtactgcctagagtccacatgactttactactccagagagagaatttatgctggattcccccaatgtcccaggacccagggctgcagcatggcaccattttgggagtggagccatcaccagagtacatactgtccaggggcccaattgctccttcatctccacatccatccctggggtctcatccacatcccaccacaggtacccagagtgttgctgcataaagacacaactgagatctgttatagctgtgcagctgtgaccctggcacctgagcccatgcagccccttataccctgtggagccagaagactggtgtgtgtgctccccagaccctgaaagccacctgcctgggcttttgctgcttctgctgca

SEQ ID NO: 207 - DNA, 146241 bp, Homo sapiens
attcaaaagactccagtaaaccttatcaccaaaaagaaagatactactaaacccaggctgccagcagattctaatctcctagaaaatgggagactttatgaggtattacagaatgttaaggagaagaatacctcatacttgtctatgccttacagcttataaagcattctcccagacatgtcctgttttgagctctgtacacaactatgtatgtggggcaggcattggggtgggtgttacaggggaatgacagacctcaatctagtatacaataagtaacttttgaaaatttttaagtgaaaaggtgatacactcagatctgtgccatagaagatacttttgtcagagggcaaaagatgaggacttaccagaaattcatttaaggagcaagaggtcctacagtaagctaggaccttgagccacagcaatcggcatgcttggaagctttttctccaagacaaaaaagtatttcagaaaagataaaaggtataaaatatttaaagagaatagggggcttgtacctcttgtacctcactttcagttttcttcctttctttttattattattattatttgttggtgttcctatttcatacacatccgtgcattcacatgcaaataatacatatcaacctttcaaatgtgtacagatgcaaggaaaagtagagattctgagcatttttggtggaatttctgtgattcaaatgaatgagaataaaatgtaaatagctggggaaaaataattatctgattgtacattaattgttattttcatttagagggtttcaagaatagaacagtatcctctgctaattgctgcctgtattcattatctattattgcataacaaatttccccaaaacttagtggcttaaaacaacaataaacatttattatctctgacagttttatgagtcaggagttctggagcagcttaagtgggtgcctggggtctctcatgggactagaatcaagctattggctgaggctgcagtcatctgaaggtttgatcccctttcaagatggctcacacacgtgacttggatttgggggcagggctcagattttctccacatagactctctcagggctacttgagtgctctcatgacctagcaactgactttccccggagcaagtgatctactagagtgagagccaggcagaaataatcctttttataacctagcattggctataacatgacatcacttctaccatgttctattcattagaagcagttcactaagtccagcccacattcattcaaagggagaggaattaggctacagcttttgaaggaggtgtgtgtcttagtctcttccagctgctataataaaatacctgagattgggtaatttataaagaatagaaatttatttctcacagttctggaggctggaaatctaaggtcaaggcactagcaggttggatgtctgatgagggcccaatctcttcttctaagatggtgccttgttgctgggcactttggaggggatgaatgctgtgtcctcatgttgcagaagaaatggaaaggcaaaaagggaccaacccattccttcaagttctataaaggccttaatcctatccatgaaagtgaagccctcatggcctaatcatctcctaaaagccccacctcttaatactgttacattgggaagcaagtttcaacataaaattcggagaggatacgaacattcaaatcatagaagtgtgtctaagattttgtgaatctattttttttaaaaaccacactttcttaacttaaaaaatgggtttgggtactttgtgctccagataaaattcccaacttactgaacagcttcacagaatcagatgtcctagggaactcccattctttggccaacaaaagcttgtcaacttactctgagatgtctcagagttgtgaaggcccacaatagtcatagttgtgttttttgtttgtttgttttttgagatggagtctcactctgtcacccacgctggagtgcaatggtgcgatctcagctcaccacaacctccgccgcctgggttcaagcgattctactgtcttaacctcccgagtagctgggattacaggcacatgccaccacgcctggctaatttttgtatttttagtagagacgggtttctccatgttggccaggctggtctcgaactcctgacctcaggtgatctgcccacctcggcctcccaaagtgctggaattacaggagtgagccaccatgcctggcccatagatttttttttaagtgtcaaccttgtaatccaaagagaaaaaggaacctaaaagtccaaaccactgtagcatcatcattcaaattattttccttggatatcaaaagaaagaacaatttttgaaagttaagtttcagtgtcagaggaaggaagaagccctaacaagttctgaggagcataaactgcaaataatgtaattacaacaatttgatacttattagaaatcaggaaaaacacctcctacctagaaaactgaaacattattacagtcaaacaagaaacttttctacatttagccaagtgaagaacaaaaaagtcctcaagacttttgagaatgctgcctgggagaacaaaagatcagtaccctaattactttggtaactttccatcataatcagtgtggcagtttgttttgctgctgcttctcctttcccttttaaatgatctgcaacttgtctgtcttttagatctaaaagataggcaaccattttcttctgtctgttgctttgattcttggcttatcagaatttctctgtatctgagctgaagtcaggagtcagcttcagagaacaaatctcaggaagtaaacaagtctgctaaaaaacaaaataacaatttgcaaacagcagcactattaacaaggaccctcaaactggtatcctcttaggagcagagtgtcttagtccattttcttttgatatgacagaataccacaaattggtaatttatatataaattccctttatatataaaaggaagaagtttatttagcatatggttttggaggctgcgaattcccagaacatggtgctggcatctggtgagggccttcttgctgtatcatggtatggtggagagcatcacatggcaagagggcaggagcacgcgagctcagatcactcttctccttacaaagccaccagtcccgccatggaggccccaccctgatgacttcatctaattcttttttttttttttttttgagatggagtcttgctctgtcacccaggctggagtgcagtggcatgatctctgctcactgcaagctctacctcctgggttcatgccattctcctgcctcagcctcctgagtagctgggactacaggcacccgccaccacgcccagctaattttttgtatttttagtagagacggggttttatcatgttagccagcatggtctgtatctcctgacctcgtgatcagcccacctcggcctcctaaagtgctgggattacaggcgtgagccactgcgcctggcccttttttttttttttttttttttgagacagagttttgctcttgttgctcaaactggagtgcaatggtatgatctcagctcccaggttcaggcgattctcctgcttcagcctcccgagtagctgggattacaggcatgtgccaccactcctggctaattttgtatttttagtagagacgaggtttttccatgttggtcaggcgggtctcaaactcctgacctcaagtaatctgcccaccttggcctcccaaagtgctgggattacaggcatgagccacggcatccgaccaacttcatctaattctaattacctcccaaaggcagccctatctctaatcaacataagaatttgggaatttaatttccaacacataaaatctggaggacacattcaaaccattgcaaaggagaaacataatatccaatggctattgcttttttaaaaacaaggagataaattgtctagtgtaattatgggggaaaatttagtatcttttggacctgaaaaggaaaaataaaatgtacttagagaaatgcaaccaagattgcctagtattggcaaaaaacccagaatatctacttttaaatcatggaacttggtgacaaaggcactatggtgcttggtacaatcataaaggacaaagtcaaggactgggaaaactgaatattaagagtgtaagaacttacaagtactgagggatcccagaggcatcctatcccacttggcctctacacattcatttgttctagaagaataaaggtagcattgatccaagtcatactgatcttctgtctctccagataagactgatttataagtttacaccatctgttggggttagtgatgttattctctctaataccagttaatacctcaaaaagggctctgtttagctgagacaaacagtaacttcaaggacctaatcataaattttttgcaattttcactatgaagaaattcagacttcatcttgatctaaaccagtgtgctttcatttgtccccagaccctcagggatctgtcttctcacttatgagacattcattcaccacctccaatacacacacacacacacatacacacacacacttttttttgagacagggtctcattctgtcacccagtctgcagtgcagaggcaacatcacagctcactgcagcctcaacctcctaagctcaagcgatcctcccacttcagcctccagagtagctgagactacaggcatgaaccaccatgccgagctaattttttgcaatttttggtagagacagggtttcgctatgttgcctgggctcgtcttgagctcctgggcccaagtgatccacccacctccacctcccaaagtgctgggattataggcatgagccaccatgcccggccttttctctccattttaagtcactccccctgccccccaactaccataattctattaaatacttcaagggaaattttgaagttggtgtccctgagccaaacttttagaagaggtacttttccctgtgctaacttcagccttttctttgttaggtcccttcacgcactggaagggaagtttgatagcgttttaaaagagtgagaaactcagtgtggaaagaaaaaaaaataaaaaataaaaacaagaaatgttagctttcagaaaagctatttcacaatacactgcaataaccacaaaaatcgagagttttgccttacaaccctaggtttaccactgaagtatgtatgacctcaagagagtcaattaactttctgattcgtagtttcctcatctctcaaatgagaaacttgaaccagttaccctaaggtatattataattctaaaatgacacgattttatatcaacatgccccaaaagttattgaccatgtgatatttgacactattattaaggcctgccaaattatattctatgtgtggacatgattccttctaaaaccagagtaaaaaccattccaaaaagatacttgagaaataatcgggcaattggggggcacccacataacgtttggttgttcagtttcataacagtaccactcttcccctcctacaaccaccactgctgtccgtttctacttccctcaatgctttttcaccctagactcttaatacctctccagggctagaagtcaccattttcttcagagcagtcccgatagtatcacctgtgtactctgcctattagatggtggaggtagcaaaatatcttacatgataaaagtaaggatcatctggtgggagaggtagagattggttttggacgtatttagttagtcccttttgcttctcaaaataaacatctttgtgctcagttaaaagctttccaagatgttcacaagggaagagggaattcttgccaaaaacttaagcccagccagacagggatactaaaattttgctgcctgtggaaacacgtggccacgcaggactttggcataaaaacagtcatctgtgcttaaatgatggcagtgtagacttctggtggttcagaggctatgttcagggcacccaggcacagtgtacagggtctgacaactccattggcagttcccattcaattacagttcacagcacactcttgtctatttacagaacttacaactcggcaaaccttggtccttatggttggaggggtaaagagaaacacttctctcactcttttcacagttttagttctgcttccaaatcttaacagttgcaaaatgctttagaagatctaggcccaagagcccatctgcaattttagtgttgtgaccttgggcaagacacttaaccatctctgagccgcaactttcttgtccataaaatggtgataatgatccttgttctactttgcttacaagaatgttgtacagatcaataaaataacataaataaaaatacattaaaaagtgctatgtaaatacaagatttttaaattatcaggtgcctcctcttcttctctgctctttcctttatctcatctgtttctgtgtcctttaagcatcttcatggtcttttcttagtccaaaattccccatgtggttaatgcttagcttcttaaacacgggctttttatcaaccaggcaaatctatacctatatatgatctacctacctccccattcagagccaatctattacctttagtatagtctcattcatttccagttgcatgaattgaggacttaatgtctctgtgtcctaggctagggatacaaaattgaacgagcagattcagccctcgaggaacacaccattagatctaagcatcttagaccagtcaaataggttcatcaggtctacataagttgcagttgaaccttctctccctggaagagaactctgcttctatgagtttaggtgtatctggacagtttggggcagaagttgaactttgaagtcctttaatcccactgttctggagaaggcaggcaactatccaagcctccttgaaattatttttcacattcctttgttgactggccccatacttccccctctttttttcctaattcaatatcttatttaatgttgagcttttgctagtgttcaagtccatgttagacaatgagaattggttccattagcttagctatcaggtcagagaaatgagaccacctgtagcaacatgacttactgtttgctctagtaaattcttgcccaggaagataaacttgtagagcaataaataatttcactgtttgtgtcaggaaattcctgaaaatcaatttatttgaaagttgctcatgtgggcaaatggccctcttctcagggcaataaattcacttacctgggcaaatagttctcttatcaaacaactatgcacttatcaagacttgctttaggaccctctcattgctgtgtccatcagatctacacctgctgggtgcggtggctcacatatgtaatcccagcactttgggaggctgaggagggtggatcacctgaggtcaggagtttgagaccagcctggtcaacatggtgaaaccctgtctctatgaaaaatacaaaaattagcccggcatggtggtgcacgcctgtaatcccagctacttgggaggctgaggcaggagaatggcttgaggggaggtggaggttgcaatgagcctagattgcaccactgcactccatcctgggtgacagagccagactctgtctcaaaaaaaagaaaaaaaaaaaaagatcaccctacaccctatgtatttctgcttctgtcttccctttctgggataatcctagaactctgtcaaggtgatgctctccctcattgcaggaggttcaacaaactcagccgcacttgatcaacagattattctggtggcttcttggggagttggcagttgacaacttggtgcatcattcagtaaagcaagggaaacagagggaaaaaatgtcttaaatttaacatttgccatttctttaaaaagacctctatagtcatcatcatgtgaaaaatcagaattttgttagagttccttattctttttatatgatttggaatagtctttattttgaattacatatgaggtggtacaccataattgttttgttacttggagcttctaaaaggctccattcactcctgggttcctccaaagatctttctgttacaaataactcccttttctacccattatactttttatatatgttgaaaagtgattagctagttgtgttcacactaaagtaattggctaatattcgaggaatttcactgaaagtctgagaggggctatgttggagttagttcactgttcacactaagcaaatttggcttgtaatctggctctctcaaccagtttaaaacctggaagtttatcaaaaatgtcacacatggaaatgagcacttgtggcacttgtttaaattcatgaaatagcagtcattttagagagaagagcttggtgagtcagaagccaatcttaccagctcagtctgagccctgctgaacctagcccatttttataaacctagaaaattgatgtctacatagcaatcatgatagttatcatgatatcatgataccatgacttgtatattttctaaaacttttcaagcctcagaggaaacatttgagttcagtatttggcttttgttgacttctaaagactaaggctgggcacagtggctatgcctgtaatcccagcaatttgggaggctgaggtgggaggatcacttgagcccaggagttcaagaccagcctgggtaacaaaggaagaccccagctctacaaaaaatgtaaaaataaataaatacataagtaaaaataaagacttataaccttctttgtaagtatgcatcccatggtaaattgagtcttaatttttccctcatggatgccttttattttaggtttatttcagaaaatccaaaggtggttactattttaaatttgagtattttgcatgcagaaattgagcacaggcttgtttcctaagcaggtaagctgggaacattatcatatcatttcttgagttctggtgtattcagcagagaccaagatgttttcaaatacattgtgctaattttgacaattgtgtgaggtggtattaatctccccattttaaaggtggtgaagccaaagctcagaatttaaatatattattaaagactttggaaaaaagtggtagagtcaaaatataacctaggtctacctaatttcaaagtctgatcttatttttaccttaccacattgtcacagactttaactcctagccatttttgaattgtttttatcttttaattctatcattaataagcattagtgagtggtatcattttcaaagaatgtataaaagatttttaaagcagaaacaaaagctcaaataatatctttatatactcacatgttaatcaagatccaggatattatttaagtaaacaaatagctatcctaagatgtaactattaatgaaactctaattaatgaatttgctcatttgtcttctttatttgaagacattactgcttctgatatatgcatatcctacaatgttatagggtaaaagagatatctcttcctcatccatcactatgttcctggttgaggcccctataacaaaagacattaacaacagaaaaacacacaaatgtatttaatatcttatacctgacggggggggcttcattcataaggaaatgaagacgtaacaaagaaacttgtgtatttttatgcttaggtttgatgaagagtagtcaattgtggagaaatatcactagaggacaaaaaaaatgatctaataataataaactgggggatcttagtaaggcctgtttgttcagattctcttctctgtgtccctgtgtcttcaaagataaagatgttccttccctccagctatcaggagggcacttctcacatgaggttcttatgacctgcttcaggggagaaacgcccgtaggtcaaaaagtgaccttcctaggttttatgacctccttcagggagggggaggggctcggggaaggtgagagtaacctgcctgcttctgctgttctcaaattccttcatcttaaatatatttaatatgccaaggcgccatattttggaatagcatgtcttaaaaccaatcaatgtatttatttacttatttattttgagatggagtcttgctgtgtcacccaggctggagtgcagtggcgcaggcttgctcactgcaacctccgtctcctgggttcaagcaattatcctacctcagcctcctgagtagctgggattagaggcacctgccacaactcccagctaatttttgcatttttagtagagacggggttttaccacattggccgggctggtctcaaactcctgagctcagatggtccacctccctccctgccccaccgcctcccaaagtgctgggattacaggcatgagccgctgtgcccagcaaattaatgtatttttaagtatttcaccttggacttattacatgtgttctttgttaatcttattaaaaagttgcttttctaacctagaaatttattttgtatcccattacatcttataaaatgatcaaatggccaaaacattatttttcaaaaattcactttattaagttaatataatatgaacctgcagcatttttatttagaagaaccatccctagtattacatattcagtacatctgcactttcttttttttttttttttttgacacagtcttgcactgtcgcccggggctggtgtgcagcggcgcaatctcggctggctgcaacctctgcctctcgggttcaagcaattctcctgtctcaccctccccagtagcagggattacaggcacatgccaccacgcccagctaatttttgtatttttagtagagacagtgtttcactgtgttggccaagctggtcttgaactcctgacctcgtaatctgcctgcctctgcctcccaaagtgctgggattacaggcgtgagtcaccatgctcggcctgcactttttctaactaaaggttcaagacactgaagacatgaagttgtattcgaccatttctgtttttaaaatgttatttaacaagttatgtgagtgatcggaagggcttcttttctgctgtttatttgcatcttatgcttttcctttttgctctgtcttctatctcatttcatttttacaccttcttacttttaaggacatttatcacacgctgcaaatgctgcttgtgcatctctattctgtttatgagcaggataatgtcattggcattttaatatttcacagcagcagcagtcatgaccaaacgttcccctcattggttttcctttttcctttctaactcttcctctttattttttgttcttcttaagcctgaacagggtacctatatgaaatcaaaagaaagctgtcatttaaaaagggatgaccctagccactagggcctagcattcaggaaaaaaacaaattcgtaccctgactgctccacaagtagcaagccagcatggatcctggactgtgaggccagtgaaacagacgcagcagctgggatggaagaggagtttctgattggcctgactacttgagaaaggttacagggagtgggaaaaatctgacctttctcgaaatgaggaatgtgcctggaggattccccacacgaaacaaagaatggttcactcatcacctgtgtgtttccattctatattcagagcaaagcagtgatctcttggttattctgtgacaggtttcttctactgtggcaaaaagcctgaactgatggccttccagatgtgtattaaaacgatgtttctgaatgggcaaaataacataactgctgttttaactcaggcatagcataacagctaagacacctccaccaggttcttcatttatacacaggcacttcggtctttctcttttatcatcttcttaccttgtaaactttaaaagtctccatggtaaatgtgataggtggcataaaggaaagcaaaggtcttgatgagagtaacataacatttacaaattaccctaaattactgctaataatagtactttgtatttgtgaaattttaaaaaatatttcatatcgctatcaaaactatccattcatttgtcaatgaatacttactggaaactatgtaccaggacctctgggtgatggggaagagagcaatgttcaagacaaataagattgctactctcatgtatctcatattctagaatggtgtgggatggagggagacaaacaataaacaagtaaacaataaatgaacagaacatatccagataatggccagatatacgaagataataaaatggtataataaagaatggctctggaggggtgactgttttagattgagtggtcacagagtctctgtaaagagaaaataggacagaatttcttagaccttgtggagaacctaaacctatctattccagtgttcttagcttaggtaagaaaacacaggtcctgggaacttaccagtgagaaaactaagatcagtagaggttaaagtcttactgtcacaaacaagtatacagctattctacacagtgcctgggcagacgtagaactgtaggcaattgcttggtcatcagacagctcctttgtgcatattagaagacaagtgcccctttctcagggaaaatgcccttgtgcaatgcacaacctacatagttaataatgtactatacgttttacaatatctaaaagggaggattttgtcttcaccacaaagaactgataaacatctgacatgatagatatgataattaacctgatttgattattccacatgagcccacaagtatatgcaattattgtttctcaattaaaaataaaataaatatttaaaaaagagaaaggaagtttggaagtggatagtttgtcagggacccaacctacttccatcttttgttctgccatatttaacttctattgctaagataacattacggctcaagattatatacatattttaggtagcactaacaagagacaaaggagatgcatgtcctgcctttaaggaacttcaaggaagttctacaacacacttcggtttacatgtcattggccagaataagtcatgtgaccttttgcaaaggcgactggaacatgtagtctgttagttaagtggccacgtgttcagctaaaatcagagttctgcttttaaaaagaagcagggcggggcgcggtggctcacgcctgtaatcccagcactttgggaggctgaggcgggtggatcacctggggtcaggagttcgagaccagcctgaccagcatggagaaaccccgtctctactgaaaatgcaaatttagctgggggtggtggcatgcgcctgtgatcccagctgctccggatgctggggcaggagaatcgcttgaacccaggaggcagaggttgcaatgagccgagatcgcaccattgcactccagcctgggcaacaagagtgaaactccgtctcaaaaaaataaataaataaataaataaataaataaataaataaataaaaagaaacagacaatggatattggaaggtagccagtagtccctgtcacaccatccagacccaggtcacctgtgtcagatctggggacaggaagtgtcagtttgtgagaaatgaaaaagctagtcattaagagttataatatctgggggctgactctaccacttactagcccagtgactttaagcaatttacatattctcttttagatttagattctttactcattggaagaataaagacactatctaatgtttagggtttcttgacgattaagaggtaatatttataagaaataaagcacctggccaggcgcgatggctcacacctgtaatcccagcactttggaaggccgaggtgggtggaatcacctgaggtcaggagtttgagaccagtctggccaacatggtgaaaccctgtttctactaaaaatacaaaaaattatccaagactggtggtgcgtgcctgtaatcctagctacttgggagactgaggcaggaaaatcgcttgaactcgggaggcagaggttgcagtgagccgagatcatgccattgcactccagcttgggcaacaagactgaaactctgtctcaaaaataaataaataaataaataaataaataaataaataaataaataaagcatttaactatatctagcacgtgagaagcatttagtaaatatgattttccttttttctatctgttataaatagttttcccagctctgcctactgcagctttttttttttgactcctttttttttttaaaggtcttaagatgagcctgtttatcttcatctctccctatctccttcttcaacagtcccaaactatgtgcacagaaagcagcttatgctccaggcacggtggctcacgcctataatcccagcactttgggaagcctaggcggatggatcacttgaggtcaggagttcgagacaagcctggccaactggtgaaaccccgtctctactaaaaatccaaaaaaaaaaaaaaaaattagccaggtgtcatggtgcatgcctgtaatcccagctacctaggaggctgaggcaggagaatcacttgaacccgggagacgaaggttgcagggagccaagatcacaccattgcattccagcctgggcaacaagagcgaaactccatctcaaaagaaaaaaaaagcaagctgcttatgcctcaaaattcctgtcacaatgaggctgagtagggaaggtcatttctggatggttcaaacatgaactagacaaatgccccttttggggtgggacagccaaaggactggtaaattacaaggctgccatgaaggcatggttgcagcctgtgatcttacgggttgtgtcctgcacagagcaccagattcagggatagagcaagggctgacatctaggctgaaatccttttgcaacaacttggggggaaaaaagagctttttttctaacaggtctaaagggtcaattcctatgcctgcaggggcccatttttctaaattccacaaaggaaacttccctgctggcttccctacaggcagtgtccccagtgccctgtcagaacaggtccaaacttcagtcattctgctttcttcagtgccctggccaccttccccagtccacgtgccatcaacaaacacaggatatagatctgcttgttcagtgtgtacctttctctgcgcctccattacctgagtcatgagtatgcatagtggtcacttggctccaacatttttttttttctttgaaaaaggaaaagacaaaactttgtggcttaaaagtagaagtgtcaagatggtgttacaattatagcaccaaagtctggagaaatgcctcagacatggaaagcattaaaatatagaaagctagttttctaaaatagttttatggcactgatgtaaatggtttggatttttcccctttaaagtttattttacttttttcttcttctgattgtaatcagtcatctaaaagacaactggaagaagcctttgagaacagtcgtttttaaatgatgagctatcaaaatgactttgggaagaaaaaaaaaaggaacctacaagtgcaatgacccagaaagtagctacacgtatgtaaggaggtataaagctccagtgcttaggttcaaggccatttctttttgcttaaaggcttgaaaacagagaagaaaaaattccacgaccccaaacaacagtaacataaaaaaactgtcacccaaagtctttcttcccagaggaaaaatgtcaaggatatttctaagttaattggacacaccattagaagtgacggtctgttttagatgttgcccctctgaaagccttttgggttgatatcactaaaccactctcttcatgaagatattttatttccaactaaactgtgtagtaaatcatatattatttttaatttttaaagttcttagagcaaattattttgagctaccaactctgttgggtcttctgctctagatgatccttaatgtgagaagtcacataatcctgaatcctgaaacactcttttttttttttttttttttgagacagagtttcactcttattgccccaggctggagtgcagtggcaccatctgggctcactgcaacctccacctccctggttcaagtgattctcctgcctcagcctcgtgagtagctgggattacaagcacccgccaccatgcccagctaatctgaaacactcttgaagtctacttggctaagcatttggtcagtgtttttttgtttagttggttttggggttttttgggttttttttttttttttttgagacggagtttcactctgtcccaggctggagtgcaatggcatgatcttggctcactgcaacctccgcctcccgggttcaggcgattctcctgcctcagcctcctgagtagctgggattacaggtgtgcaccaccacacctggctaatttttgtatttttagtagagatggggtttcaccatgttggtcaggctggtctcgaactcctgaccttgtgatccgcccacctcggcctctcaaagtgctgagattacaggtgtgagccaccatgcccggccggtggttttggggttttttttgagatggggtcttgctatgtagcccaggctggagtcagtggtgtgatcttggctcactgcagcctcaacctcctgggctcaagcaatccttccacctcagcctcctgaatagctaggactacaggcgtgtgccccaacacccaggtaatttttgtaaacttttggagagacaaggtctttttatattgcccaggctggtctcaaacttctggcctgaaacgatcctcatgtgtcagcctccctaagtgttgggattacaggagtgagtcattgtgcccggctcttgtgttcatagtttcatgaagaacttgtgattttttttttgtcagattccaccatcttctcattatattaatgaatgccacccacaatgaaaaattaacattttcggaactagagagagtaaaataaggtaagatactaatattgttggccattttttgactatatatcagcacctgcagcatatgccatagcagttcccatttcatgtaaatatagcctcaaaaagtgctcttttttgtcccacgcctacagtgcaaaaagataaaagtcaaaaactttagtttaaagttcacttttttaagtttatgtaaccaacttgtgacagctaatattataaccagagataactcaagaaagcctagttatggtatactggaaaaagaatagcagataactgtggaatgcaccatcagtgataaatgactctttaagcaaaagtgtcaggcagttcaaaaagcaaaaaggcaagctgtaaacagcagtaggcagagggcagtcttaatatgcatgctgttgtttgaggggcctgcagagcatcaatcttttcagttacaatttgcagatacataatacagaaaacctctatgataaaaccttctggaaaggaaaattgacatgtgtacaaacagaaagatttcaatgacaccccaaaatatactaatgtgaatggtgcagcattaagttctgtaggaaaaacaattgtcctcagaaatcatccattcattcattcatttagcaaagatttattggatatctactaagtaccaggcactgataggtcctgggaccacacagataaagaaaatatggtccctgcaccataaatctcaggttttattaaaacaagtgccatctacatatactcaaatgcattcatatgtgcaacaaaaggtagcacaagaatttcataagaaaagctgggagctgtggcctgtgcctgtaatcccatgctacttgggaggtagtgtgggagaatgcctgagcctgggagtttaaggctgcagtgagctatgatgacaccgctgcactcagtcctgggcaacagagtgagatcctgtctctaaaaaagaaattaaaattaaattaaagttaaaaaaaaaaaaagaattttgtaacagccctatttataattccccaaacaggaaacaaccgaaatgtccatcaacaggagactggataatgggagagtcatacaatgaaatactatttagcaatgaaaataaaagcaattgcagccacataaatgaattttacaatgttagtagatataaaattttacaaagaaggtagatataaaaatatcatattgcattattccatttatataaggtttaaaagtggcaaaatgaatttgatagagcacacgataaggcttagagtggagatgagggggtagtaactggtcagtgtacagagggcactgctgggcagttttgttttctgacctgggtggtggatacacagttatgatcactttgtaaaaatttattgatctacacacatgcatattcagcatttatcttacatttctgttaaaaagcacattgaaaaataaatgccagctcttttaagcaatatatttcaatgtatgttaattgttgggagtgtttcaagaacgaatttttggcctttctgtgacttgcctcaattttcttgtgcttggactctatccagaggaaagtggatgcttgaagatacagcattggaaatatcattaaagatctttaataattttcttccaattttgaaaaaaatcaaccacattttggtctactcatcgtttaacagcagctctaaaatgttaagaattctgctaagaacttaccctaacagcaaattcatatacaaaaattttgctaatttttcaaaatcaagttcagatcttaagttaaattgttatttgacatttgctttctacatattaaaaacctaccaagaggtttttgtcagcggagtgaattctgagagaaatctaacgtgggcacaaagaagttacagccccaccaaatactgttttgtttttatatttgagtgcctacctgccaattactgtttattagcttttgctcatgtgggcagatgcccttgataaaaccaaaatttgttattgaacaaagtcaaattctccaggtaggtacaatgttggagacagccacataattcatatctgcccagggctaggaccttgagttgacaaattttgccaaccttaactagtaaagcttagatttgctaccaggccttttcacctagaagtccatgaccatgttctcagaatgaaatgtactttcatgggcattctggaggtacaagaactactctgtttcatttgtattctaagcggccaggcttgaggactcatgcagtctttaatttataaatagcattttataaagcacagaattccaagaggtagaaaatgttgtgttacagaaatggtgaataagtagaaagtaaatagtccttcagcaatagtgaattttgacaggaaaacaatgctagcataagcctatcctacatagtgactgcctgtgttctttaagtgctactattgtattttgtttgatttaaaatagaatgaaaaattctcagcctgtaagtcccaagaagcagactgactgacatcagtagcatatgccccagaatgaaccaaagcagacattaaaaatatatttaattgtgaaaaattccaaacgtacacaaaagtggagagaatgtgccaattacccagtttcaacaaaaatgaacattctatcaatcttgcttcatctatcccttccacctatacctatttccttcctttatttctttttacttcctccctccttccttctcttccccttcctttttcttttcttctttcttgcttccttttcctgaaaattttatttttatttttatttattattattattttttttttttgagatggagtctcgctctgtcaccaggctggagtgcagtgacacgatgtcggctcactgcaacctccgtctccagggttcaagcgattctcctgcctcagcctcctgagtagctgggattacaggcgcgcgccaccacgcccggctaatttttgtatttttagtagagacggggtttcgccatgttggccacgctggtctcgaactcctgacctcaggtgatccacccgcctcggcctcccaaagtgctgggattacaggcgtgagccacagcgcccggctcctgaaaattttaaaagaaagtctcagacatcatgtaatttcctttgtaaatactttagtaaacacctctaatttttttttttttttttagacagatgtctccctctgtcgcccaggctagagtgcaatggcaccatcacagctcatacagccttgatctccctggcttaaacgaccttctgcctcagcttcccaagtagctgggaccacagacacgtgccgccacacccagctaattttttttttttaatattcttgtaaagatggggtctccttgtgttgcacaggctcatctgtcacttttttatgcagaaatttgttatagaaactggctctgctgggcacggtggctcacacctgtaatcccagcactttgggaggctgaggcggaagaatcactagaggtcaggagttcgagaccagcctggccaacatagccaaactctgtctctactaagaatgcaaaagtagctgggtgtggtggtgcgtgactgtagtcccagctactcaggaggctgaggcaggagaattgcttaagcccaggaggcaggagttgtagccagctaagatggcaccactgcactccagcctgagtgacagagtgagaccctgcctcaaaaaagaaaggaaaagaaaagaagaaagaaagagagaaagggagaaagaaagggagaaagagagagagagagagagagaaagagagggaggaagggaagaaggaagggagggagggagggagggagggagggagggagggagggagggagggaaaaagaaactggctcattttttcctgtaagatgttttattttgcatagggcagactgtctccttgtggttatttcacttgttcctctatcctccataagcggtggttaaatctagacattgattagattagatttgattcattcatttttttttttttaaccatcgtggccattttaggcctcaatttgctgtcatttaaaatgcttttggacttggcataattccctgctgtatatttttgttgttgttgtttttagttattatttaatatggtactttattctgttagtggccttttgtaaccgcccgatgggttcaccttgtcctctgcctagacagagctgatttatcaagacaggggaattgcaatagagaaagagtaatttggccggtggggtggctcatgcctgtaatcccagcactttgggaggccaacgagggcgtatcacctgaggtcaggagtttgagaccagtctggccaacatggtgaaaccccatctttactaaaaatacaaaaaaaaaaaaaaaacaaaatagatgggcatggtgacatgtgcagttgtagctattcaggagactgaggcaggagaatctcttgaacctgggaggtggaggttacagtaagccaagatagccccactgcactccagcctggggggacagagcgagactctgtctcaataaataaataaataaataaataaataaataaataaataaataaagtaattcacgcagagctggctgtgcaggagaccagagttttattattatgcaagtcaatctccccgaaaacttggagatcagagtttttaaggataatttggtggggggcagggggcagtgaatcaggagtgttgattggttggctcagggatgaaatcatagggagttgaagtttttttcttatgctgactcagcttctgaggggaggccacagaactggttggcaggtccaggtgggaccatccagttgttagaaatgcaaaaacctgaaaagacatctcaaaaggcagatctgaggttcacaatagtgatgttacctttaagagaagttggggaagttgtgaatcttatgacctccggaataatggctggtaatatttaggattccagcccttctcattctaacttgggtggctggtggcctttcattcattttacaagaacagtctagcttttgggaagggctcttgttatttaaactgtaaactaaattccttcccaaggctagtttggcctatacccagaaatgaacaaggacagtttagaggttagaagcaagatggagttggttagctcaggtatctttcagtgtcataatttccttagttatagttttggaaaggcggtttcactcttattccgtgaatggacactcagcctcttatcagcagagctgggaagagaacctaaatctttccaagtcttatgctgtgccctatctatcacagaatgcttctggaaggagaagaagagctccctttttgtatttctcacatccaccataatcttttgaaattagaaccctgcagcagtcttggaaaaagtaccattccactcttcccagtcaaggactcataaaacccaccgtaaggacaatgttaatattactgttgcagttgaaaattttctttaccatcagcaattacttttacagtattttgaacaaaattgaatgctgggtcagagaaaacaaattcctagggattgacgatcatcaatgataattctttccatttcctagtgtctaattttttcagatcagcttgtcatatattcattgtgactatcttaattattgtaagcctcactagtattaaaattcttttttcccaagactggcaaatagaatctaaatctttccaagtcttatccggggccctttccatcacagaatgcttccggaaggagaagagctccattttcctatttcttatatcaattactgatcattgatgatgattattgaaaattgttaacgttagataatgtaaaccagaaagtatctgaaacaggactcaatcagtatagaaagttattttgtcaaggttaaggacacatctgtgacacagcctcacaaggtcatgaggacacacatctgaggtggttgaggtacagcttgctgttatacattttaaagagacatgagacatcaatcaatatacgtaagatgtacattggttccatccagtaaggcgggacaacttagtggggtggtgcttccagatcataagtaggtaaaagacaaaaggttgcattcttttgagtccttgatcagccttccactgaatgcacaatttagtctgcctcggtgaatctgcatttttacaaaatagggcagagaaagcaatcagataagcctttgtctcaggtgagccttagaaggatgactttgagttctgcctgttttgtccacaaggaatttccttgtgggcaaattgtgcgggaggtatgtagctttttatcgtggtagctatcttatttaggaataaaatgggaagcaggtttgcctgacatagttcgcagcctgacttttcctttggcctagtgattttggggtcctgaaatttattttcctttcacaataataagtaatagggtttgctataataatccctcttttaaaatgaaataagataggctggtcgcggtggctcatgcctgtaatcccagcactttgggaggccaaggagggtggatcacaaggtcaggagatcgagaccatcctggctaacacgatgaaaccccgtctctactaaaaatacaaaaaattagctgggtgtggtggcaggcgcctgtggtcccagctgcttaggaggctgaggcaggagaatcatttgaacccgggaggcggaggttccagtgagctgagatcaggccactgcactccagcctgggcgacagagtgagactccgtctcaaaaaaataaataaaataaaataaaataaaataaaataaaataaaataataaaattgaaaattattattttcttctctcatcatgcctaaaatcaggtgtccaaaagataacaaaatcttaagtcaggttgtcatattgacacagagggtttggaagctgtcttttgactcaaacaagcttaggcctcttctgttgcagaaacaccactgtattcattgctatttattacaactgaactctgttactgtgattttagccttgtctccacgggaacccatttatttatttattttgtaaatatctgtattctgttgaaggaagcccatttattagcaaaagctgttacacactttattttcaaaaatacccagtgttttgaaaagactcccaagttgtgttttcctctactctcataccaccaccacaacaatcatcaacacagaagacttcggtgaccaaacgtggggatttttccccacatgccaagcagtgaacaccagctgggtgtcctccaattaaattccacactgtcgccgggcgtggtggctcatgcctgtaatcccagcactttgggaggccgaggttggcggatcacctgaggtcaggagttcgagaccagcctgaccaacatggagaaaccccgtctctactaaaaatacaaaaaaaaattagccaggcatgatggcgcatgcctgtaatcacagccactcgggaggctgaagcaggagaattgcttgaacctgggacgcggaggttgtggtgagccgagatcgtgccattgcactccagcctgggcaacaagagcagaactccatctcaaaataaataaataaataaataaataaattccacagtctacccagagacagtgtcagatcccataaggtgaggttttagtccccaaaactgcccctaaccccaaacaccagtcgttaagtcagggcctctggaacttctgacccattggcttcaaattgggattcccaaaaccccctcctcgggtttgattaatttgcgggggcagctcacaaaactcagggaaattaattattctattatgtttactggtttattataaaggatattaccaaggatacagataaggagatgcataaggcaagatatggggaaagaggcttccatgccctccctgggcgcaggacactccaggaagctccatgagttcacctatctggaagctcccgaacccagtcctcttgggtttttatggaagtctaatgatgtcagcatttcttcccccagtgtataaggcgggacggctctagtgggggtcttaagactcacaatcagaaaggcgggaaagatgagagtcctgccttggggcaggtgaaaggagagcaggaggtcagaggccttcccctaaggcctaacatgcccaacatgataacaaaatactctaacaggggctatgggagttatgagccaggagcggtggacaaaaaacattatataatacctatttatgtgtatataccattatatattatatatatgcatatataacattgcatatcatattattatataattatacacaataccaattaatttatatttttagtattactaattaataatatttattattgatttatattattatctattaatattattatataattatatactattaatatattatatatatataaaatctcctggccccaagcgatcctcccatgtcagtatttcaagtagctggcactacaggcttgaaccaccacaccaggctaattttgtttatttttttatagagacaaggtcacactgtcttgcccaggctggtctcaatacatgtaatataatatataatatacatattatatccatatatatgcacacataaaataacaccacagccagtagtgaatatgaagtcaatattgttctagatcagggagattattgcatcccccaattgctgagggaagattacaaggcacttgtctgagacttgcatggttctactgaagtgaagcagtagaactcatcaggcacattttttcaaatgaaaagaaatgtggcattatgcatgcaattatggacctttaaagataaataagccttagagaagcatcagagcttctcaactgaaattaaagatccttaagatagatatggaaagaaattctccaatgccatccccttaagcgtagctgaatttcagtgaagagtaattcaagaagtaaaaaactaagtatgggttatcaaatgtttcttatccaaagacttttcttggattttgggattttcttctacttctttttttgtttttgtttttaactcttattttatatggtattttattctcttcaaaagtgatctcttcaaaatcatgtagctttatcctgggtgggtttggggcaaatctcagcttctcttgaatctcctcaggccttttaaatcaggttcagcatctgtatttttaatattaaattgcatacattaaattccattataactagtatattggcattttttacttgttttatttcaatactattatgctatagtgaatgttgagctagaagtcagtctcattttaaaaggagtaaataaaacattgataacttagatgtaagcttcttactgtgtttgagttttgaagtgaagaaaaagtgagcaagttaaaggaaaatggctacttgcatattagatgaaaaattacaaagtgctaaaacagctcatctctcctctctgtcttctcccatacagtattaatggcatctgatcacgaacttgtgctagtaaaaagtctgtctttcctgagtagagaccatagtaaataagcattgtctaggattagtgattctgaccagtgcagcaaacacttggatctgttgaaagatggaaattgtttgaaagattctccccagggcctgaaagcttgaaggcatgagtaactcctcccttcttaggcccagttccaaggcgcaaggctatttgtgccagcagcctgcgccagcaagatagcagaagcaggaagagagccggttagaagacatgtaccctgctgcaagacacctatccctgaagatcgagagagtccatcccggtaccacaaggcagttacgacagactgggacacttcctgtttacaggaagctataaaacccctcccccgtcctcatttggggctgacgccattttaggcctcagcctacctgcacccaggcgctcattaaaacagcatgttgcttcactctgcctggtgttgtctgtcggtgcactttcggggttcgaaccgatataagaaccttacaaatagaactttttttttttgagacagggtctcaactctgtcacccagcctggagtgcagtggcaagaccatagcttattgcaacttcaaccggctggtctgaagcagtcctcccatctcagtctctcaagtagctggcactacaggtgcataccaccaggccaggctaattttacttatttattgtagacatgaagtctcactgacttgcacaggctggtctcgaatacctggactcaaatgatcctcctacctcagcctcccaaaacgctgggattacaggggtgagccacagcgcctggcctaaattcttcctgtatttgcttggtgaaagaactaaactttcccagcatttttacttaaatgaacagaagtttgctagaattggatgttcaggaatttgttttgtatttagacaagagtttatgacactggcttacctcaaaaatatattttatggtattaaaacatattaagatttagaagcattttaacaaattcttacaactactgatcagaaattatcatgacagttaatatttatgcttccctctgttttcagtttcatccaatgcttctaatttaactactgcatggcatgtttcagaaaaaattgaacaaataaaaaatttgtattccattggcttagatttaaattttatatctattttatcttcatacatgttatgattttcaatacacagtagcagaaaactcaggttgatttttcctgcgcaaaacgaaaaattgaagattgcacaaatcagttttcctgaagtgtaagtaactgcaatcttaaagcagttgaatgctctgctatagaaaactagcatgtgtatgtgtatacacacatatatatgtatataaatctatatattgaaatatttgccttagtaaaatcattgggatctctaagaatggtatcgaatggaaagtctgggaattcttatcaggaatcctcataaactcaagccctggtgaataaaaataatagaatgaaggccaggagtggtgccttacacctgaaatcccagcactttgggcggccaaggcgggcagatcgattgagcccaggagttcaagaccagcctgggcaacattgcaaaatcctgtctctacaaaaaatacaaaaactagctgggtctggtggtgtgggccttttgtcccagttacttgggaggctgaggtgggaagactgcttgagccggggaagtcaaggctacagtgagccgtgttcgtgccactgcattatagcctggatgaaagagcaagactttgtctccaaaatttaaaaaagaaaccaaaaaaataataaaaaagtatagagaattgtttcctaatatcatcaaagaacagaggctaggaagggaaaatagcaaggcaattttatatatatattatatatgtatttcaagaagcaatagatattttaaggattaactaaaatctttatagtcttcgcaaggtatattttattatttctttattttgcactaaaactcttaaaagtatagaagacgaattgcagaaaaggaatccagcaaaatggaaatatttatgtcctaccctaaaggaggaactataagtggtagagcaggtggtaacagctgtagaaaagaggccctctagacaaatcctaaggggttttggaaggaagaaagagatgttggcctgagacctgagatgaaaaaactaatgaagctggtatggagctttaactagcctgaggcctaattgcttcctcaataggtgatggatttagggcagcagtcctcagcactggctgcacatcacaataacctatgaagcttttgcaaagtttccatgctagggcgaaactctcttgagagtaaggtataaccggatcgaggtgggatgagggcctgggcctgagcattttaaaacattgccaggaatttctgtgctttcaggatttagaaccactgaggtaaggtttttctcacttgatatgtttatttttgcaagttcagcatctgaagatgtttcttttgaatttattatgtgcaattactatatcctgctgttaggtgagtaatgatcccattagttctttgggccacggtctagccaggcttaaagtatgagaaacagagaaaaacagtagcacactcaaattttttaagaaaaaagtaaaataaaatatactttattaaaacagttcaatacatgtaggattacaaccctccaaactaatgtttaaactgagcttgaaaatcagtctgataccttcctcactaatctgtagttgttagcaatcaatgtttattctcaacttggttattcataaccattcttctttaaaatgtttccttcattctctaaatccttatcttggagataggcctcttatattgaacactagtatagtcttacatgactgtttctgtccaaaagacatttctatgttctggaaagaaagtgaaatgcttgttcattgtattgtatctctttaatttcattttttatgtcttgtgtgggccaaaatgtaacatgctttttccacattagtagtcataaaacaggcaggacacggtggctcacacctgtaatcccaacactttgggaggctgaggcaggtggatcacttgagctcaggagttgagaccagcctgggcaacatggtgaaaccccatctctactaaaaatacaaaaactagccaggcatggttgtggatgtctgtggtcccagctacttggggagctgaggcagcaggattgcttaagcctggtaatttgaggctgcagtgagccatgttcttgccactgttccagcctgggtgacaaagcaagaccctgtctcaaaaattttttaaaaagacataaaacaaacttatttctgatatatgtgtcatgcaaaagaatgtatttattttctataaaaacattacactttagaataatatttaataaaagaaataatagaaaattaccattttgcaatcatcatacaaataattaattcaagcagcagtcatcaatggatgctaagatgcttgagttcaagtttcacagcatatttatctagtcttaaagtacttcccacaaactagaataacaaagatgaaagtggtaactttatagtggagaaacctggcagacactacttcaaccaagaaaggacattccaagggcacatgtcgtcaggacctcctgaagctgtgtcatcggcaaaaaataattcaaaaaaagaaaagaaaaaaataaggacataccggtaattatgtgcctcctgatgtgaagcaccgagaaggatacattatcacctaatatggtgttcccaccaaaaatgcctagcctgaaactgatcgtaaaaaaataatccaaccagcctggacacagtggcttatgcctgtaatcccagcactttgggaggcctaggtgggagaatcacttgaggccagcctgggcaatatgttgaaaccctgtctcttcaaaaataggaaaaaattaactgagtgtggtggcacacacctgtagtcccagctactcaggagggtgaagtgggaggattacttgatcccagaaaattgaggctgcagtgagctgcggtggtaccactgcattctagcctgggctgcagagtgagaccaggtgtcttaaaaaaaaaaaaaaaagtccggtcacagtggctctcgcctgtaatcccagcactttgggaagccgaggcgggcagattacttgaaactaggagtttgagaccagcctggccaacagagaaaccccgtctctactaaaaatacaaaaataagctgggtatggtggcatgcgcctgcagtcccagccaatcaggaggctgaggcaggagaatcatttgaacctgggaagtggcggttgcagtgagccgagcttgcgccactgcactccagcctgggagacagagccgagactccccctcaggaaaaaaaaaaaaaattgaagaactgtgccatatcaaagtagattaaaaagcatgacaattagatgcgatgcatgatcctgaatcagattctggatggaaaaggtaattattttttcacaaacgatattaaaggaacaactggagaaatttgtatatgcattgtccagtaccacatcattgttaaattttcagaatatgatcattgtgagaggtgaagccggctgggcttctgggtccggtggggacttggagaacttttctgtctagctaaaggattgtaaatgcaccaatcagcactctgtgtctagctaaaggtttgtaaatgcaccagtgagcactctgtaaaaacagaccaatcagcgctctgtaaaacagaccaatcagcaccctgtaaaacggaccaatcagtgttctataaaatggaccaatcagcaggatgtgggtggggccaaataagggaataaaagctggccgcctgacccagcaccagcaacctgctgcggtccctttgtgtgctttgttatttcactcctggcagtaagtcttgctgctgtttactctttgggtctgcaccatctttatgagctgtgacgcgcagtgggaaggtctgcagcttccctcctgaagtcagcgagaccaccaatgcacggggagggatgaacaactctggacctgccacttttgagagctgtaacactcacagcaaaggtttttggcttcacttctgaagtcagtgagaccatgaacccaccagaaggaagaaactcagaacacatctgaacatctgaaggaacaaactctggacgcacaatttttaagaactgtaacactcagcgcgagggtccgcggcttcattcttgaagtcagtgagacccagaacccacgggcaggaaccaattccagacacaactgtgctctagatatgtaatgcaaagtcatggtttttgtgagacacatgctaaaattatttaggggtaaagaaccgtgatgtctgcaggttactttctaatcattaatatttcatcaaagtaataaaataattatatacagaaagaaaaaaatgacaatttgttaacaactgatgaacctagatgacagatataagggaactcattgtactatatctgtaagtcttcgatttttttaaaagtaaaaatttgaaaaattcacatatataggctgggtgtggtgactcacacgtgtaattccagagctttgggagaccgaggtgggtggattacttaaactgaagcatttgaggccagtctgggcaacatagtgggaccccgtctccacaaaaaatacgaaaattagccaggcatggtggtgtccgcctgtagtcccaggtactcggagactgaggtaggaggatcacttgagcctgggaggtccaggatggtccggccatgaccaccccactgcactccaacctatgtgacagagtaacactctgtctgaaaaacaagcaaacaaaaaaaacgaaatccaacaaactcagagtactcaatagcattgttaagagacaaacattgtttgcgaatgtccctagtatgttttctttttttattccacttctccttttacccactcttgaacacttcaacaaaaaaatttttttcttgagacggagtttaactcttgttgcccaggctggagtgcaatggcacgatctcagctcaccataacctctgcctcccagattcaagagattctgctgcctcagcctctcaagtagctgggattacaggtatgcgccaccaggcccagcttattttgtatttttagtagaaatggggtttctctgtgttggtcaggctggtcacgaactcccaacctcaggtgatccgcccacctcggcctcccaaagtgctgggattacaggtgtgagtcaccatgcctgaccacttcaacaatgatttgtgaagagacagacagtaaagctctaggaaagaatcctacttaaattaaatcattttaaaattgacaaaatcctttcatagttcaataaccatttcctaatttataggtttaataaattcaggctttttgatagttgggttttcctgaggtttttttgtttgtttgttttttgagacagagtcttgctctgtcacccaggctggagtgcagtggcatgatcttggctcactgcaacctccgcctccaggttaaagcgatattcctgcctcagcctcctgaatagctaggactacaggtgtatgccaccacacctggctattttttttttttttttgtatttatagtagacacagtgttttaccatgttggccaggctggtcttgatctcctgacctcaagcaatctgcccgccttggcctcccaaagtgctgggcttacaggcatgcgccaccacacacagcctgagggctttttttttttttttggtgatagagtctcactctgtcgcccaggctggagtgcagtagcacaatctcagctccctgcactgcagcctctgcctccctggttcaagtgattctcctgcctcagcctcccaagtagctgggactacaggcatgtggcaccacacctggctaattttttacttttagtagagatggggtttcaccatgttggccaggctggtctcaaactcctgatcctcctgcctcggcctccctaagtgttgagattacaggcgtgagccactgcacccggctgagtttgttttatcatagtaaaatatatatagcataaaagttaccattttaactatttttaatggcattgagtatattcgcattgttgtgcaaccctcaccattgtccatctccagaattttgcatcatccattactgaaactgtactcactaaacaatacttccctattcctactgtatatctttatatattttgcatattaatcccttgtcagatatgcgattcacaaatatttcctctccattttattgtttgcctttttactttgatgcacaaagtctttaattttgatgaaatctgctttgtcttgtgttctgtgcttttggtgtcatagccaagaaatcatttctgttttgattttcaaagtggtgaatagccataggttttttttttccccctcacatttagaaaagaaatgagaattccagttatttatcatctgtggcatgtgcaactgacacattttggtggcagcagtgtgtaacttcaaaatgaaagtacataaattttttgtaagtaaattatcactgacccatttgctgaaatgtagttccttttttttttttttttgagatggagtcttgccctgttgcccaggctggagtgcagtggcgcgataccggctcactgcaacctccatctcccaggttccagcgattcttctgcttcagcctcccgagtagctgggattacaggcgcgtgtcaccatgcctggctaatttttttttttttgtatttttagtagagacggggattctccatgttggccaggctggtctggaactcctgacctcatgatctgccctcctcggcctcccaaagttctgggattacagacatgagccactgcacctggcaaatatagttcattttaagtcatccttttctcaggggatttcctcatatgctccaaaacaaatgcctcagtttgttctgttttgttttgtttctgttcaggcctcttcattttgcctgagtgtcttttgtgagatatccacactgctaggcacagatgtcctctacctgtgcctgtctctgaagactgtaacttgccctctggccagagggagaaggaggaaaccttgcctcttccccagccccgatccaggtgccttgagcttcctggcatagatgtctgtttcaacttcctgccccagggtggacatggtgctcggtccagcaggtggcaggaggaagaaccattgtgaaaggtgtcaagactaccacgataggagaaagagattagagttcaattccaaatacagcaaggacagtggaaatttattaatataaccaagaaacagaatgtgaggtgtgtgcgaggtcattggatgaaaaattacttgagaagaaacatcaaggatagaggaagtcttgttacactgacttaataggattcttgctaaaggtagaccaagtaatcagacatcaaaggtaggtgcttccctctaaactgatgtagtagcattcttgctatttattactgggccatgcaagcccagcaagcatgcggaccaaggtcaagggctggtgaagaagagggctcaaactaactagagtttaatcaaggagcaaattgtcgtcagtctctctctctctttttttttttttttctgttcaaagagagaagagtcaatacaatacagtggacagtacagcttttttttttttttttttttttttttttttgtcatccaggctggagtagagtggtacgatcatgtcttattgcagcctccatctcctgggcccaagtggtcctcctaccccagcctcctgggtagctgggagcacaggtgtgtactgctatgccctgactaacttttttattttttgtagagctcaaccaatcctccccctaggcctcccaaagtgctgggattactggcatgaaccactgtgccaggcccaatttgatacttttcttgcagttcaacgtatcaaataaacataattaaaaaaaaactctctctctttacaaggtgaaagaataaattctttgagattttccagaggccctttaggaaaactcaaattccattcaaaatcaagatttcatttagaatttgatttggggaagacaaaattgtcagaaatatcaaaaggtttgagcatttgaatagatgaaatctatgtgtgacactgtgaaacaatagccacctatttgaccagagtgacagcaaaagaattcaaaagtaggccaggcgtagtggctcacacctgtgatcccagcacttcaggaggccaaggtgggaggatacacgaggtcaggagttcaagagcagcctggccaatatggtgaaaacccatctctactaaaaatacaaaagttagcagggcatggtggcgcatgcctgtagtctcagctactcagaagcctgaggcaggagaatcacttgaggcaggagaatcacttgaacctgggaggcagaggttgcagtgagccgagattgcaccatagcactccagcctgggctacagagtgagactctgtctcataaaaaaaagaattcaaaagtaagtatggaagataaaacagccgggcgtggtggcttacacctgtaatcccagcactttgggaggcagaggcgggcagatcatgaggtcaggagatcaacaccatcctggctcacacggtgaaaccccgtcgctactaaaaatacaaaaaaattagctgggcctggtggtgggcgcctgtagtcccagctacttgggaggctgaggcaggagaatggcgtgaacccgggagccggagcttgcagtgagccgagatcgcaccactgcactccagcctgggcgacagagcaagactccatctcaaagaaaaaaaaaaaaaaaaaaaaggaagataaaacaactgtaaaggaaacatagcttttttttttttgatacggggtcttactctgttgcccaggctggagtgcagtggcatgatctcggctcactgcaacctctgcctcctgggttcaggagattcttttgcctgaatagctgggattacaggtgcccgccaccatgcccagctaattttttgtatttttagtagagatggggtttcattatgttggccaggctggtctcaaactcctggcctcaggtgatctgcccacctcggcctcccaaagtgcagggattacaggtgtgagccacggcacccgtctcatagctcttttaaaaagtgaaaagtgttgtcttcaataatgaaggacataatcaaggttaacacaaagcatagaaaattactctgataagacacaaaatcttggtttcctgggcagatcactcaaaagagaaggataacctctttctcttacaacctcttattaagagcagaccaataatccaaggaaactttgtcatttttaatatagagaaagctaaattgtagtttcacaccagtgtacttttggtgtacaattttactctttctagtgtactttttttattttttaaagcccttataaataaacctatccaatcttagtcagctttgaccacgagataaaattccttttccaagattccttttccacaagcactctacaactttttatatccattcagtttttgtcttctactttttatctttctcattctggaacaaccagtcattttaatctaggataaaattactctctttttctcttaacagaaacacatcctacattgcttgcatactttttatgcaaagttgcttctcctcacccttacaatttctagtagttttatttacatatattgattattatttttaaccattagtaacctttttttttttaacagagaatactaggaagtagacaattgtggattgtctgtcacataccagccgtctgtggcagactagcgtattttatgaatatatatcatccgacaacttttataggtatatgcttcttcatagtacaattttccaatgtggcaaaaagaacatgtttattaatagatccaaatatatttagcttggctgtaccatataaaaatgagaaaccagaagtatataaaattaaacttatgcttaataatgaatgtttcagtagtttatcttacttagaaatgatctacatatttaatggatatctattatttaacttagcataactgtaaggttccaagttaccaaaaagattttggaaactattttcaggcagacataccattaaacatagctagccatcatctcacgttatttctctgttaagtacttttatagtctacgcctgttaggcaagtatcgcataagcaaaaacctaaaaagtttcaatacattggtttttttgttttactactgtgcttgatatgcataaagtaatgaatatcaagtgactcatttttactacatcattacttgtacatttgttcttagagtgaatttataatttttataatctttgtgttgttgttgttttgagctagggtctcactccattgcctggctggagtgaatggcgtgatctcctctcactgcagcctcgacctcccaggctcaggtgatcctcccaccttggcctctggggtagctgggacgacagccacaagccaccatgcctggctaattttttgtattttttgtagagacagggtcttactatattgcccaggctggtgttgagctcctgggctcaggtaatctgcccaccttggcccccaaagtcctgggatttacaggcatgaaccaccgcacctggccaatttttataatcttaaatatctagtaaatataatattacctcacttgactagtaaccccaagtagaataaaaatgagcatatcatacttaatgatgaaaattataagacatactcatttttattaagccaataataccaaattagtcttatttatcaaagatttactcaatacatgtgaacttgaaaaacatttgggttagttcttatatttctaagagttttaggaatattaactttacttaagcacgtatttatctctaagtgaatttaaacagcattcttttataggattttagaaattaatttgatggggccaggcgtggtggctcatgtctgtaatcccaacactttgggaggccaaggcaagtggatcacttgaggcctggagtttgagaccagcctggccagcatggtgaaaccctgtctctactaaaaaataagagaggccaggtgtggtggctcatgccggtaatcccagcactctgggaggctgaggtgggaggatcacctgaggtcaggagttcaaggctagcctggccaacatggtaaaaccctatctctactaaaaatacaaaaattagccgagtgttgtggtgcacacctgtaatcccagctactcaggaggctgaggcaggagaattgctccaacccaggaggcagaagttgcagttagccaagattgcgccactgtactccagcctaggcaacagagtgagactacgtctcaaaaaaaaaaaaaaaagagagacagacaataaaaatctgtccgttcggtttttaatttttaatttaatttaattttattttatttttacagagttttgctgttttgcccaggctgaagtggcacaatctcagttcactgcaacctccaccccctgggttcaagtgattcttctgcctcagcctcccgagtagctgggcgcccaccaccatgcccagctaatttttgtattttcagtagagatgaggttttgccatgctggccaggccagtctcaaactcctggcctcatatgattcacccacctctgccccccaaagtgttaggattacaggcgtgagccaccaagcccagcctgtccttacatcttaagaatcaaaatcaaaagtgcttcaacagactgtcatttgctgcccttcttcaggagccagactcatcaacgtgatccctaaccagtcaggagtgaaggcaaagtcttcaaaggtgaacacttgaggtcctgggagagcagttttgggagtccattgatgaatctgatcctatgtgagtcacaacaccataacagttcaggaaaaaattattctgacacttgttacaatgataaggaagactttattcaggacaattacaataggtatcaagactcaatagagtagagagacagggctcaattccaaatacagcaaggacaaatggggatttataaccaactttcagagttgtggagtctatggatggaaattatgaagatgagacatcaacggtagggaaattctttttttttttttttttttcctttttgagacaaggtcttgctctgttactgtcactcaggctggagtgcagtggcacaatcatggctcactgcagccttgacctcctgggctcaagcaatccttttacctcagcctcctgagtagctgggaccacaggtgtgtaccaccatgcctagctaattttttaattttgttgtttttttagagatgaggtcttgttatgttacccacactggtcttgaactcttggcctcaaatgatcttcctgcctggcactcccaaagtgttgagattacagacgtgagccaccatgcccagcctacagtagggagattattgttaaaccaacttaaacagggctcttgttaaagcaggccagggtgatcaggtattaaggatgagggattctctctatactgacttaatagaattcctgatacaactgaactatgcaggcctggcaaggatgggagccaacattgaggctaattgaaaggagaggagaattcagaggatttttgtttttttttttttgagatggggtctcactatgtcacccaggctggaatacagtgggtgagatctcagttcactgcaaccttcgcctcctgggtttaagtgattctcctacctcagccacccttgtagctgggattacaggtgtgtgccaccacagccggctaattttttttttatttttttgtatttttagtagagacaggttttcaccacgttgggcacactggtctctaactcctggcctcaagtgatctgcccacctcagcctcccaaagtgctgggtttacaggcatgagccaccatgcctggcccattcagaggatcttgactaaaatttgatcaaggagagtctttgccagtccctacaagggggatccgtattttcattttgcactaggccccacaaattgtgtagctagccagtcctgtacatagcccaggtagcatgaatacgtacgctatttgtttccttgggattctatttcctcaggcattagctggcgaaaagtttagcctgaacattctttttgccacaatctggtctccagatctcctagtgaacacatgcttggacaaagccaagcacttatctcccaagaatgaaataatttttagctatggattagttgcaattcagtttatgcaggaaaatattttctatctctagagtggcacggttcagttgataaggtgctaatttaaatgactaagcagaatgttaacatctcagttcaaaggatctgagtttgtgtaacttgctgattcatggcttcttttgaagaattgggaattaactggccttaggtttatattactaaaaagttcaccaaagtgtggctgggcatggtggctcacacctgtaatcccagctactcaggaggctgaggcaggagaatcacttgatcccgggaagcagaggttgcagtgagctgagactgtgccactgcactccagcctgggtgccagagcaaaactctgtctcaaaaaaaaaaaaaagtttaccaaagtgaacagaaatgaggagttgacctaaggacaaatttcagttctttacccccacccagaatgcagaagcaatcccccaaattgcagttttccagcttcaaatactcgaagatccagcctccatcagcccttgatagcaaagcttttgctgctgtaattgttatactaagattctttgattttattttcgccaagctttatagtatgcacttttcctttgagtcgcacttttcctttgggtcacacttttcggcctttggaacttgccctatgctatggtttgaatgtgtcccccaaagttcatgtgtcgggaaattaatccccagtgcaacagtgttgggaggtggggcctaataagtggtgattatgatatgagggctctgtccacatgaagggggttggttagttattgtgagaatgggcttcttataaagtgagtttggcccctcctgctctctcacacatgctctcttgcccttccgccatgggataacatagtaagagggtccttgccagatggaggcccttgacctaggacttcttggccctcagaactgtaagaaataacttaaaaatagtaataacaaattgcccagtctgtggtattctgttatagcagtggctcatacctgtaatcccagcactctgggaggccaaggcgggtgggtcacttaaggtcaagaattcgagaccagcctggccaacatggtgaaaccccatctctactaaaaatacgaaaattagccaggcatggtggcacacacctgtaaccccagctactcgagaggctgaggcaggagaattgcttgaacccaggaacccaggaggcagagattgcagtgggctgagatcacaccattgcactccaacctgggcaatagagcgagactccatctccaaaaaaaaaaaaaaaaaaaaaaaggcagggtgcggtggctcatgtctgtaatcccagcactttgggaggccgaggtgggcggatcacaaggtcaggagttcaagaccagcctgaccaacatggtgaaaccttgtctctactaaaaatacaaaaattagctgggcgtggtggtgtgcacctgtagtcccagctactcacgaggctgaggcagaagaatcacttgaatcttgcggggcagaagttgcagtgagtcgagattgcaccactgcactccagcctgggagacagagcaaaactctgtttaaaaaaaaaaaaaaaaaaaaaaatggaataaaggacaggtctagttttgtttaaacaggccccaggaataaagacctgtttttaactgtaggctgcttttaaattaagttcagttttgagaattgaattcattcagattaaccgtagagacctcaaggttactagattcctaaaagctactcacctccagaagacccaaatcgggtaagcctggaagttgacaaagcaacaaaagtggatcctgactctagaaatccaaagcagctcttgaccctctagacaacttcagtttcctccaggactcacatggaagcaagccaagtagttattacatatctaattcagtgtttgagtgaaatatgagagtgttgtattgggttaaagggcataggaaatccttttcgtcacatcacgatggctcttcattttatattctttgaataaggaagattccagaagttaccttctcaacacaaatcacaatggcttccacgatgggcagtgatgcttgagaaatgtcatgttgcttaacactcagactttttgaactatgcatcaatgtatttgtgtaaaatacgactgtaagggcccttcatgcaaagatgtctgcaaacattttcattttcttgtaaataattactggaaagggaaaaaagcaattagaaagaaggacttcagcatcctaagttcttgtgccccgtccaaatctgctttctaaagtctctatgggaaaaccagaaatatcattttaatggcctgggggggttcttgcattataagtatacagagcagtatgttgagaaagctgagtgctctgaatcacccaatgtactttatacatttatttagagaagaatagtttagttttaattatttatgataatagctctcagtgcactagtaaatgtcctttggtgcatattttgtaaaagtaatgaagtctttgtaatgtgagctttctcttcagctataagctgccctctttttttgctgaagaaccagggcagcagaatgtgtttgtgtttgtgtataagtgtgtgtataaattaccaggcttgaggtttagcaaaatgctattgaacgtaattgaggatttctaagaattattcctggatgtactcactgtcccatctcccaatcatcctctcttacagccatagccttagcaacttggccagagaaggaatcaccatgagggagatgagcagcctgtctgaatatttgtttttgttttctttcagtgtttttcttattgttcttcctctgtggcaataatctatgatattgtaataaaacacatagctagaaagaatataaatctattgtatttccctctggcctaagttatatatactatagcttatggataagtcttattatgtcaaggaatcttctctttttttcttttcttttttttttttttttgagacagagtcttgctttgtccccaggctggcgtgcagtggtgtgatctcggctcacagcaacctctgcctcctgggttcaagctattctcctgtctcagcctcctgcatagctgggattacaggcacgcaccaccatgactggctaatttttgtatttttagtagagatggggtttcaccatgttggcaaggatggtctcgatctcttgacctcatgatccgcccacctcagcctcccaaactgctgggattacaggcgtgaagcaccgcgcccagcgtaattgccttattttcaaatgagatcctaaactaatcatagtcattcagacagaataatagttctggcaatgtcaaaattatccacctacagattagacatggcttctgtgtgagtgaaacatactgaccagctttgcttcttgtctctagaaaaaagaaataaagagcctttcagacattagatttgaagtaaatgggccacccatgaattaaaaccaatggaagaaatcagataatctggatggaaatctgggggctgattcttgtgggacaaatgcagtgcctggttcctgaagcaacaatgccagaagggacatgtggggaacatgtcagactgaaggcaccctgctccatgtggatgggcacaaaatcggcggcaacttctaaaatgcgtggcaatgccacctgcccatcaaggttagaatgtcagttcacagatgcaacagaaaagacaagattgatcatgaaaattgctttaacacttcttttctttttctttctttcttttctttttttgagacagagtctcactctgtcgcccaggcgggagtgcagcggcacaatctcggctcactgcaacctctgcctcccaggttcaagctaattctcctgcctcagcctcctgagtagctgggattacaggcacatcccaccatgcccagctaatttttgtatttttagtagagatgggatttcacgccgggcgcggtggcttacgcctgtgatcccagctctcagggaggcaagaggcaggaggatagcttgagcccaggagttcgagacctgcctgggcaatatagtgagaccccattctccagaaaaaggaaaaaaaaaaaaaaaaaaaagaaaaaaagagatgggatttcaccactttggccaggctggtctcgaactcctaacctcaggtgattctcatgccttggcctcccaaagtgctgggattataggtgtgagccattgcacccagctttaacatttctatctacaaagttttcttgttaaatggaagaggactattgcagtcatctattgccatgtaacagatatcccaaaacttaatggcttaaaccataccattttatttatttgcttacaattcatgttaagattcattagttcatcatgagatccctccaccaagaaaaaaacaaactgtattgatcacctttggaggatcctagggaaacaactggctaatttaaaatctgcttagatgcttttgtagttcataggcgtggtaattgggtgttcacgtgcatgtgtgagatgtgtcacgctccagccttgttacaacatcagcatgttatccatctaacatgaaaacaataaaataaaacaaaataaaattgggttaatagagagaattaagaatttatcttgtctttacatatactctacctgccagcattgaagaaacatttgtcgacaaaagtatttcagataaaaaagaagcaatttttaaaatcaccatttgtaacccctaattagctgctgaccctaggcaatgactatcaatgtctgataatgtcataagaagagacttttgaacattgtatgtgcctcctgataggtgtgtgcaacatcacccattaagttgtgttgccaacaataacaaccaagtgttgaatctgatcaggcctttagttctaactaccatttcacaggaaataacaaggaacactgtaacacattttcttaaaaaaacagtataaggatggaatcagcaaaatctagactatgggaaactcagtaggtcaaaaaaccaagtttcttcaataaaaaaatttaaaaataaaacagagagtgatggggtggatggtaaatgggtgcagatgtggggagaaagttaaaatacttagcaatcagttgcaatgcatgggccttatttggatccaaacaaaaactgtaaaagaagaagaaagccaggcacagtggatcacacctgtaatcccagaactttaaaaggccaagtggatcacttgagctcaggagttcaagaccagcctaggcaccatggtaaaaccctgtctgtacaaaaagtacaaaaattagccaggcatggtggtgcatacctgtagtcccggctactcagggagctgaagtgggagagtctcttcagcccgggaggtggaggatgcattgagccatgatcatgccactgcactctagcctgggtaacagagcaagaccctgtctcaagaaaggaaaaaaaaaagaagaaaaagaaaaatataataagaagtcatttggggaagtgtgaacaatgaccagatatttgatgatattaaggaattattgttaatttttttagatgtgatggtaacattataattttgcttaaaaaaaaaagagtttttgtttgggtgcagtggctcgcatctgtaattccagcactttgggaggctgaggcaggaggactgtttgagcccaggagttcaaggttatagtgagttatgatcctgccactgcactccagcctgggtgacacaggaaagccctgtctcaaaaaatagttcttatcttttagacataatactaaaatatatacaaggaaatgatgtattatctagaattttttctaaataatcaggggtgagattgtaggtgggtatataagtatataggtgaaacaaaagtggctatttattgttagctgaagttaggcaacagatacgttgggaagttcatactattatctctatttgagtgtgtttgagaagttccatagtatttttttaatcaatggaaatgactgaaagaaatgaaatatcatagcttccaaaccagaatgtggagaaaaggaaagagagggcagggagaaaaaacaagaaaactttattagtcctgtagaaggcaagaaagaagaaaaaaaaagttacccaaatagtcatctcctagtaaatgagaccccttttcccaaatcttacacagtcatgtttcaactgctcatatctggtctctgtagtgaaagtgcattgagctaggacaagaggttctaatcctggccctctctgggctaagttgtgccttgcatggctcctcaggctatattaagagcctggacatcctttgaccattggcagctttgtgacagctggctggggctcgagattcagtttgctgccacagaagaaagcaaagccaactgggtcacatgaggaagtaatctgagcccttagctccaacctgtaaactaagtttcatcttgcctgctgctgtgtggctgtcagggataacctgatgccacatgaccaaaagaaaaagccaacctctaagacccccttgccgagaacgttgtcttttacaaattcttgaaatatgatttggcgagtttctagtaagagtgactggcaactgacttgaatgaaaataaatgtcagagaagggggaaatgggattggaggaatgaataccacaaagatggctgcatcttagtgactgtatttttagaggggatgggaatcttgaagaggaagaaaatctttcttccctctctcaaacattgttatgaatacatgttacttatttttttcttccttccaggtgcaaccctttcagctgctttctagttatttccccatatgttctctatttttttttcttttttgccctttgatttcttttttcaaagcagaactctacttattgccatctactaagcactgcatttctccccatatctctccctggatgtgcagctttcttatctcattccccatctccactcctgttccccttgcctctttgtcaaatcttgtgctgcttttttgttgttgttgttaatcgctcctctgcctctgcttttcctctgaatttctataccttagtcactctgaaactcagtgccttgttctcttcttgctcttgtcccctctagtgcatataacgtccatgaaaggattatgcagccagaagctctcagagtaaggtcagagtgttctgatgtggaaaagcttctatagtgactgcactttattggtggaggttgttgtcactttttatcctcctagagcatttactaggtataatgttgggatctttctttgttttgctcataaaaatctcttagggctctgaaagtcaggttgctttttccttcctaacttctgtctcaattttattatcaccttaagtggcatctggttgacaatgagaagaaagaattcagagaaagaaatagaatggaggaaaaaatgacctgtgacacccaccaaaatccagcttgggcttagctaatgtttttcttgagaaattgtggtacaccaacacggtaatactcttttataacgatggagatctagaactgttctaaaaaggaaacaaacaaaaaaaactatatgaaagaaaatttttaaaaaattagtataccaagttggtagattcacaaattatttacttggataacaatacctaaacttactgtatcagcaccatccaaaatatcttctatatattcacccatagttttctcaacagatttatgggccaggtcctattataagcccaattctgcaggtgagaaaaatgaggcacagagaggttaactcttttgtccatggttacacagttagtaagtagtagtctcagatctgatcccaagccatctggctacagagttcacggaattggctgctgtagcattttgaatttttatagaaattcttatttgctttcattaataaagctctaaatcaagtttagccctccagtgtttcagtaagaagatgagtttcaggatttggaccacctaaaaattttgtataaacctcatcacattcgacagacttctacctgatattcttaggtaacaggcagtgggaggccagagggaagccagaggagaaggtgtccaataataagaaagtcttcaggctgggcgcagtggctcacgcctgtaatcccagcactttgggagtctgaggtgggcagatcacaaggtcaggagtttgagatcagcctgaccaacaggtgaaaccccgtctctactaaaaatacaaaaattagccaggcgtggtggcgcatgcctgtaatcccagctattcaggatcgcgccactgcactccagcctgggtgacagagcgagactctgtctgaaaaaaaaaaaaaaagaagaaagccttcagttcctttgtttgtttgtttttgagatggagtctcaaaatggtagcccaggctggagtgcagtggcatgatcttggctcactgcaacctctgcctcctggattcaagcgattctcctgcctcaccctcccaagtagctgaggttacaggcacctgccaccacaccgggctaactttttttgtattcttttagtaaagacagtgccatgttggctgggctggtctcgaactcctgacctcaaatgagctgcctgcctcagcctcccaaagtgctggggttacaggtgtgagccactgtgactagccaaaagccttcagttcttaaagtgcttttttttttgaggcagagtctcactctgtcgcccaggctggggtgcagtggcatgctcactgcaacctccgcctcccgggttcaagcgattttcctgcctcagcctcccgagtagttgggattacaggtgcgcaccatcatgcctgactaatttttgcattttttgtaaagacgggatttcaccatgttggccaagctggtctcaaactcctgacctcaagtgatcctcccccattggcctcccaaagtgctgggattacaggtgtgagccactgtgcctggcccagttcttaaagtactttaagtagttagttgttcctaattatccaccactagacataatgctaatatatccttatagcataatctttgtttatatccatgattctaaaaaagttataatgaagacagtttaaaaataagtcatataattttcaccagtatcaggaaggaatattataagatcattgttaaatgatagttttcagagaaaattattttatatgaaaaattctaagtagaaccattgcatagaatacaattcaaaaattttaaaaagaacaagaagagactcaataaggataaattttaatgtaaccagaaatcagactgtatatgctggaagtaatatgtgattttaaaattcaacatgcatggccgggcatggtggttctcgcctgtaatcccagcactttgggaggccgaggtgggcaaatcataaggtcaggggtttgagactagcctggccaacgtggtgaaaccccatctctcctaaaaatacaaaaaattagctgggcatggtggcatgtggccataatcccagccactcgggaggctgaggcaggagaaacacttgaaccctggaggcagaggttgcagtgagctgagactgtaccactgcactccagcccaggtaacagtgcgagactccatctgaaaacaaaaacaaatcaacatgcacaacttaatttaaaggaattttaatatacaatgatataggccgggtgcggtggctcaaacctgtaatcccagcactttgggaggccgaggcgggcagatcacaaggtcaggagagcgagaccatcctggctaacacgatgaaacaccgtctctactaaaaatacaaaaaaaaaaaaaaaaattagccgggcatggtggcgggcgcctgcagtcctagctacttggcaggctgaggcaggaaagtggcatgaacctgggaggtggagctggcagtgagccaagatcgcgccactgcactctagcctgggcaacagagcaagaaagactccatctcaaaaaaaaaatatatatatatatctatatatatatatatatatagagagagagagagagaacgatataaaaaaatagaaagatgtagttgtgacatgaatgtgctattcatgtattgcaggcgaattgtcaagatgatatggtaaatttacatatgctggtggtagcaagtataaaacccagatatataagtcaaggtaggaaatatctatcatttgagaaggaattatctacaaaatgtaagattttgaccaggagccaagaaaaaggctgttgagcctcactgttagctcttgctcctatgagactacagaaaagctatctctcttctgttgtttacagtgaattgtctataatcttttaatagttggcaatgaatttgctggaatagctgagtgattatcaattcttatactctacagatcaatactccatcattaaactttggacatagctttcagttggctgggaggaagaagccaaccaagttgcttttccaagatgtgtcatagcaggcagtgtgagagactaagctgagatttaccgtatggctaaatatcctttggactccaaagttttgaagattactgcaggacattgaaggtgactgagactcacaccttcagtaactagtttctggtctgccctattcatatcaatgtatcatatcaatgatatgtagcctggaggttttgataactgacttggaaattctgccatagtctcatccttttattccccttactaatagagggttgaattagtggcattgtggtaccaaattctctggatgcatttgtgcaagtgtgtacacatgcatactcattacctctttattttctttgtgtgtgtgtgtgtgtgtgtgtgtgagacgaagtcttgctctgtcaccgaggctggagtgcagtggtgtgatctcagctcactgcaacctccgcctcctgggttcaagcgattctcctgcctcagcctcccgagtagctaggactacaggcgcgtgccaccacaaccggctaattttttgtatttttagtagagatggggtttcaccatgttggccaggctggtctggaactcctgacttcaaccaccacgtccagcccatacccattatttctatttcatatcataaacattctgaaaatttatttttcttttatgtacccgtcaacttttaaagtttaattttttaatctttaaataatttacatgattcaaattttaaaaaatataaatgtatacactaagaagtctttttctcctctctgttcccattctaaccaatcagttcttatttctgcaaacaaccaatgttgttagattttctatatccttccagacatatttaaagtatatatatataagaaaaaatatatagctatgttattgtttttttttttccttttactcaggtggcagtctattttgcatactttagagcttacttttatcagataaaactaaattttattatgttcagatgctttatctatcctggttatctctcttgtcctactctcccatttctcactcccaatatgcatttactctgcacttttgtatgctagaaatacattagtccattccctgattagtttagtttaggtgtttttgtttgtttatttgtttgtttgtttttgacggagtcttgctctgttgcccaggctagagtgcagtggcacaatcttggctcaccacaacctctgcctcctgggttcaagccattctcctgcctcagcctcctgagtagctgggattacaggcatgtgccaccacaccctgctaatttttgtatttttagtagagacggggtttcaccatgttgaccaggctggtcatgaaatcctgacctcaagtggtcctcctgctcccacttcccaaagtgctgggattacaggcatgagccactgcgtctggcctagtttagtttttattgtgctgaaatcttgcatatgtttagccactcaatattgtctgtttaaatggaaacccccaaataatgtgatatacacatgtacatcttttttagtacagaatctagtataataccaagaataattatgagtttaataaatgcctttttatgacactgatttcttttcttttctttttttttcttttttttgagatggaatctcactctgtcacccaggctggagtgcagtggtgtgatctcggttcactgcaatctccgtctcccaggttcaagtgattcttgtgcctcagcctcctgagtagctgggattacaggcatgtaccaacacacccagctaatttttgtatttttagtagagatggggtttcaccacattggcaagcctggtctcaaacccctggcctgaagtgatctgcccacctcggcctcccagagtgctgggattacaggtgtgagccactgcacctggccatatgacactgattttttatttatttgccacccacttagtgttctgaaaccagttctatctactttggtgactattcaattaaattttagcttgttaatatacatggattggccagatactggtagaagagatataggaccatgcctttatttagtcagtatgttataaaaagagatacaaaataattataaatctctgaattctttagaattctatctacgaactttatacaatccaaatcaaaataccagttagatttttttaggacattaaaaatacagttaggccaagcatggtggcacatgcctgtaatctcagcactttgggaggctgaagtgggaggactgcttgagcccaagagttcaagaccagcctgggcaacatagtgaaacctcatctctaataataaacaaacaaaaaaagcataaataataaaaatatatataattgtataaaaaatgaaatatataatatgtcattatttgtgtaagttaataatatctgagcacaaaatcatatacattttgtacctacaaccaaaagaatacacattagaatggtttcctggggcttgtggggagggaaaaagaatcaaaatagagtattggggcaaaggaaaataagtaagtagaataaaagcagatacttacacaatccattgatggtcatggaccatgaactgagaaatataattaagtcatctttctatgcccaggcaaggggcagggatgggaggtagatagcagagactttatgtctttgggtgagcctaaattgatgggacccttccacataagatttgagacactagacccagatacctttaaaaaatatatctcttacagcctgaatctgaatactggagactgactgattacagattctttcttagaatagaaaggggtcacgaagagctcaaagaacaaatgaaaacagacaaaaaatctgccctcattgatgggaggatgtcagaggtacacaggagccagctgtagaacttccagtagccaatgggaaaacaatttaagcaactaaataacaaagtagtattggactatataactcaacatatcagaggtcgggcatggtggctcacgcctgtaatcccagcactttgggaggccgaggtgggtggatcacgaggtcaggagtttgagaccagcctggccaagatggtgaaatcccatctctactaaaaataaaaaaaaattagctggacatggtggcacgcacctgtaatcccagctacttgggaggctgaggtaggagaatcgcttgaacctgggaggcagaggttgcagtgagccagaggttgcagtgagccaagattgagccattgcactccagcctgggtgacagtgcgagtctctgtctcaaaaaaacaaaaaactcaacatatcagtattcatgagtccatactgatataaataaattattgaataaattaataaattgaggagaacaaacaaatctttcatgctctcctgcagaagaatgacaaataatgtatgtagatactccatccataatgaagggagcataactctgcactccttgagtgtgggctgcacaaggagtggggagctatgcttcccaaagagtagaatgcgcaaaatggggataaggagtagccgcccgctggggaaaccagacgctccctcagccaggtgatcaagggtcacatcagcagtaataaatcatgttaatagatgtgcctttgtgtgatgtgatgaaaatggcactgtatctcagtgatcttcccaacaccacagaaccccagggtggctcatgcctgtaatcccaacactctgagaggtcgagatgagaggatcccttgagcccaagagttcgatactagcctgggcaacatggcaaaaccccatctctacaaaaaagacaaaaactagccaggccatggtggcacgtgcctgtggtcccagcaactcaggaggctgagatgggtagatcacttcaacccagaaggtcgaggctgcagtgagccacgattgtgccactgcactccaggatgggcaacacactgagactctgtctcaaaaaaaaaaaaaaagaaagaaagaaagaaagaaaaaacagaaattccttttttttttttgagacagagttttgctcttgttgcccaggctggagtgcaaaggcgcaatctcggctcaccacaacctctgcctctaggttcaggcaattctcctgccccagcctcccgagtagctgggattacaggcatgtgccaccacgcctggctaattttgtatttttttagtagatatggggtttctccatgttggtcaggctggtctcgaactcccgacctcaggtgatctgcctttctaggcctcccaaagtgctgggattacaggcatgagccaccacacccggctgaaaaaacagaaattctgagactatcatatccaagaggtggctcaggagacacgaaaatataatgtactatcctgaaaccaaaaaaagacattaggttaaaaagtaaggatatctaaataagtatggattttagatattaatcatgttttaatatttgtcattaatggtaatatacaataataggtgaaactgagggaggtggtagaagtgatatgggaactttctctactgtcttaatttttctataaatctaaaactgttctcaaaaaaagggtcatcacaaaaaaaagggggggtcatgaagtcagtggtctatgaaaccctgtaaaaatgtgacccatccccctctatgtataacaaaaaagttttctttcttgtcttccagctgaggaagtatttgattggtttggttggtttttgctaaacacagaagaggtctttgctcagagacacagaaagtgtttctcttctcttcctttggtgttatgagtgagcttgccaaactcgaaggcagatgtcttagcaccttccagtgttaatataactatgtatctggttggaacctgccccgaggctcccaaggcagctaataaatggccagtaatgaacactgatggccagaggcttctaaccattaggacagtggacccattctttcccagtcctcaaagttcaaccacatgcaactagaaagatagttttaaccaatccaaagtaatgttggttacagaatctcttagcaccagtgttcagacaggattacacgttggggttttcatcttctgatcctagcatggtacctaacactcggtaggcacttaacacatgttcattaagtaaatggcaatgtgttcctagagttcagggcagaattttaatatttcgtatatgggtctaataaagcaaagagccgtatagcctggctggcaaaataattatcacctaaaaaatttattaggcattttctaattcacgaaatttatccgttattagttcaactactataagtttcaagcctctgaatagcagaacagttcctgttatgggaatgttgggtcatatgtcacttgaaaggtatctttccctaagtatctattaatgtgctagcgtggactcaaaactggcctatcaggaatatttaatgtttctctcatgaggaaccttgaagcagtcgaattttataatttttttgtgtatttttttattagttacagaaccttgccaattcactcaagctaatctgcaagtcctgtcattatcacaaaaaagtactctggcaaattaaccccatttctcaatgcaggcttaataggaaagagagctattttgaaagctcaggggattacaagcactctttacaaaacgtactgcaacacactagactgtgagatacagccttaaatagttaaacaagtccatcgacataaactgggtacatttccatccttgattcttccctattgacttcattacttaagatgtacctgactggaagccggaaaaggcctcttgggagtgagcagccctggtggaggggagcagagggagccccttatttatgagggagagaagacatcattggaaacgtataagatttgaacaacaagcttcactggaatattattgagagagcaatacttggttatatataatcaggggttttgtaatgaatctgtggaaaggtaaccagtaattgcttagtataatctaaaactctgaaaaccttgtgataaaatagctacaaagaaatcaaatcaaaacacagtctcagatgttttgatcattgaagttggaacaattgggatagccttgaaagcttatctctaaaataagttcttacagaactccgtgagcagagaccaaaagcagacttttagaagaactaacttcaaaaaagattccctatataataagagtcattttaaactgaaatgatcaagacctcctagggattctaggtcatgcctaaaccatcacggtcaagttggacatgtatagagacctggtactctcactcttccaccttcggccccacttatatcccaggctgggcattgaagttccccatcagtcagttggacgggggtacaggacaggcccctttaaacgcagaactccctcaatactgcagaacactggaagagctcttgttcaagtgggtaagtgcagcctgagtgtctggtgagatcaaacctgaagagagcgtgagataaggagagagttgagtcattagtcatctcttttaactaactctctgaagttggctggcttcacactagacctggtgattaatggtaaagagatagctcttgcaattcaacttctgtaagtagaaagaaatttaaagcttcccctgagcattcgcttcctcttcgaatgcttcaaaacaaatctcagcatcagtaggctgatgccagttctcatcatgccccacaggccttgatgagggagacggagagagccaggtgtgccctattgaacaggccccaatggttctctgccttttcatagcaatctcctaaagggagaaccagagtcatcaaatctcaggacaaaatggcagccctaagagggcaatccactgtcagaaagcatgcataagctattattctgaagagaagaagattatttccattcactatagggctagtctgaagtttgcaaagaagtccttttcattcaattatcccttgaaggaaagtatgtatgtaaaagttaagaaaattcaatatcaaaaatagtttttgttttggctttgaaatttttcttaatatgtaagcaaaattcttagttctggagttgcagttactcagttatcaaaaatgatacagataagataacaaaccccattaaccacccagttgctcaaacagaaatctaggattcatgttaattcctttcttctttcacccctcacacccaatccatttgtttcattagttctcccttcaaaataccttaattcatccactttctccattctcatggcaccattctaatataaatcatgtctcacctgaattgttatcataacctcttaaacagaactaactcttgcttccatagtctatttcatggcagccagagagagatttttaaaacacccataagatctgtccaggcatggtggctcatgcctgtaatcccagcactttgggaggctgaggcgggtggattgcctgaggttaggagttcgagaccagcctggccaacatagtaaaaccctgtctctactaaaaatacaaaaaattagctgggcgtggtgacaggtgcctgtaatcccagctactatggaggctgaggcaggagaattgcttgaacctgggaggcggaggttgcagtgagctgagatcgctccattgctctccagcctgggcaacaagagtgaaactctgtctgaaaaacaaaaaacaaaaaaattggccaggcgtggtgatgcatgcctgtaattccagctactagggaggctgaagcaggagaattgcttgaacccaggaggtggaggttgcagtgagccgagatggtgccactgcactccagcctgggtgacagagcaaggctctgtctcaaaaaaaaaaaaaaaaaataggatctactgtgtcagtaaatctttaatggcttcctcacaaggccttacatagtttggcccctaactacctttcgacttcatttcctactttttttttcctgctaacaccactggtcctgtttggggtttcatgactaagccaagctcttatttccccttgtgtcctctggctgtaatgctgatcttctcataactggttctttttcgttcttcaggtcttagcataaatcatctccacatttaagatcttcctactggacctggcgcagtggctctcacctgtaatcccaacactttgggaggctgaggcaggaggatcacttgagttcaggagttcgagaccaacctaggcaacatagtgagaccctgtgtctaccaaaaatagaaaaaattagttgggtgtggtgctttgcacctctagttccagcaacttgagaggctgaggtgggaggatcacttaatcctgggaagtcaaggctgcagtgagccatatttgcaccactgtattccagcctgggggatacagtgagaccctgtctcaaacaataataataataatcttcaggccaggtgcagtggctcacacctgtaatcccagcacttgggaggccaaggtggatggatcacctgaggttaggagttcgagaccaggctggccaacatggtgggaccccgtctctaccaaaaatacaaaaattagccgggagtgatggcaggtgcctgtaatccctgctaccatggaggctgaggaaggagaattgcttgaacccaggagcagaggttgcagtgagcggagatcatgccattgcaccccagcctgggcgacaagagtgaaactccatcttaaaaaaaaaataataataataatcttccttaccaatccatagcttctccttccctggctgtcttctctttgttagtatcatcccccgtttgttttatttacagcacttacaatctgaaattgccctgtttatttaacggatatgcctattgttggtcttttccactcacaacaaaatctaatctcctaaccacatctgtcttgtgacatcaccacatctccaatacttaaaacagcacctagaacaatgaagagtcattaaaggaatgaagaaaagaaaagaaggaagtatataaccaaaagcagattggcaaactctttttttttttttgagacagagtttcactcttgttgcccaggctggagtgcaatggtgtgatctcagctcactgcaacctccgcctcctggattcaagcaattctcctgcctcaccctcccaagtagctgggattacaggcatgcgccacaatgcccggctaattttgtatttttagtagagacggggtttctccttgttgtccaggctggtctcgaactcccgacttcaagtgatccacctgactcggcctcccaaagtgctgggattacaggtgtgagccaccgtgcctggcgggcaaactcttttggcaaaaggccagacattaaatattttaggctttgcaggtcacttaagacttttgtcgcctattcttcttcatttaaaataattcttggctcttacaaaaaaacgaaaaaacaaacaaacaaacaaacaaaaaagcagatcaagggctggatttgccccaagggccatagttgccaatcctgatctagattaaggaagaagtttatctataaccctagttaatgtctaaattctgcaaacctgccagagttctaggttgtagtataatagaaattggagtagaaggccgggcgcggtggctcacgcctgtaatcccagcattttgggagaccgagatgggaggatcacctgaggtcaggagttcaagaccagcctggccaacatggttaaacccatctccacaaaaataccaaaattagccggtcataatggcgggtgcctgtaatcccagctactcgggaggctgaggtgacagattcgcttgaacccaggaggcagaggttgcagtgagccgagatcgtgccattgcactccaatctgggcaacagagcgagactgtctcaaaaaaaaaaagagagagagaaagaaattggaatagaagtgccagtcatgacttccttgcccatgaccccttcttagtgaaactgatccatccacagtttggaaaggcagatctatatacctcccgattcctcaacacgtcttacttcctattcatgactgattgtaccagatcaccccatcagatgacctctctatggaatttgaaattggaccactgaaatagaactaactagatgctgatggactcttgaagtaaaatatgtagttgggtaggtccatgacaaaccaaagccaaaggtaaactcatattttcagagaatggagatagcacaataaaaaagaagtcagtttgttcaaggaagcttgagaaagaaggagacacacagatagaagcacagacctgctgccacagggccccaagaagggtgaaaggactagccttgggtcctgaatgtccagctccatgtcccatacggtctaggtgtgcttcactaatgtccttgtatatctgggaagtgttctgttgtatctcttcttttatttttgagacaaggtctcgctctgtcacccaggctgcagggcaatggtgcaatcccggcttgctgcagcctggacctcttgggctcaagtgatcctctcacctcagcctcccaagtagcagggactacaggcatgtgccaccacacccagccaattttttaaattttttgtagagatgggctctcactgtgctgcccaggttggtctaaaactcctgggctccagcaatcttcccgttcaacctcccaaagtgcaggcgtgaaccactgtgcccagcttctcttcttaacttacctaatttgagacagtttctattcctgaccagaggaatgggtgtttcaagttaccgtcaaacctatcaatgaacacacacgtgtttggtgggtgtctgttatgtttaagacactgagagacatggtggggcaaacaaatacatgcaaaaaataacaattgtttccaggaaaagtaaatctggtagaggaatgagacataaataacataaaatgataattaacagtgtgaggcagtgtatggtaagtaccgcatatcagggttttatgtgtctaagatgttttaaaagttaattttaatggtatttagaacaaaatgaaaatagatgctgaggaaataatgactactatttcaaaagaaccacaacagtgaattttgacaaataaaattgttttgatcagaattattaacagaaaattgttttgatcagacttaataacattttaacaatttcaaaactgctaaccatgtgtcaaatctattaagatgaactgagaataagccattctggtgttctttctgaaagagataatgactatcctcagagtatctaaaaagtgtttggtcttaacaacaaaggaccagatgaagtccctgttgtgtcaaagtaaagtccccagtatttcatcaatacagacatcatgctaccagttgcttaaaaatgcactgcctgatatagtctttgtgctgacaaaacattcactaggaagagcgatctctagagatctatgtctgatgtgagttcgcataggaattaatttttcctgaaccaagatttgtagagatcttctagagatgctttctgcaaaatttgctcaacctgaagtggaaataaacttcatggtaaaggcagtaaatttactaggattttttatttttttaaagtaagtttgtaagggcaatacatttatcaggatttattattttttaaagtaagtttatagcaaagtattattttaaaaggaagtaaagatgggagggaagagtaagaaaatgggttgcctgctctagcaatgcacagaaattcagtatatgtaaaataatctgctatttagcccctaaacagtgtttttattcatccactgggcatttacacttgacgcaaaacaaggtatgagtcagtaattaatttatgtctatgtgccaatattgatagtactataccattaactaatcagtggctctcaagcttaagtgtagatcagaatcacctagaggcttgttgaaacacagattactaggccccactctgagtttctgattcactaggtctggagtggggcctaagaatttgcatttcttttttctttttctttttgggactgggtcttgctctgtcacctaggctggagtgcagtggtgcaattacagttcactgcaaccttgacctcctggcctcaagtgatcctcccacctcagcctcccaagtagcttatgaccacaagtgcctggctaattgttttaacttttaaacgttttgctagagacaggggtctcactatgttgctcaggctggtctcaaggattgctgggctcaagcaatccttccccttgggcctcccaaagtgctgggattacagtcatgagccaccaccccccagctgagaatttgcatttgtaacaagttccccaggtaatactgatgctgttggtctgaggaccatggagagaaccaattaactaaaaactattatactgacatcagccctgtcaccagtctggtctttcctgctgcatatacctagggagacaactagaactatatgaagaaagagtctaaggtggttttcttatgaattctattgatgaaaaatcatacagtggtgtgggggattctatctctaattctaattaatttttaattttttttcttcatataaggtcaaaggccagctgccagtgtttgcttaagtaaagaagcacatatagcaggcacaagcaaggaatgaattcaagtgaaaatctcaccaaagtgaaaccgattggttcacgctgattgtccagtgacagtgctgggacagtccagttttggtggttgggaaggattatccaaaggaataaaatactggcacatgctacaacacagatgaaccttgcaaaagttgtgctaagtgaaagaagctagtcctcaagaccacatgttacatgattctgtttatctgaaagtccagagcaggaaaatgcatagagacaaaaagtagattgattagtagttgctggaggcaaggggtggttcactaaaggggaagagtattctttctgaagtgatgaaaatgttctaattgtggcaatggttgcacatatctgtgaatatactaaaaaccattgaattgtgtattttaactgggtaactgtatggtatgtgatttatacctcaacaaagctgtcttttgaaaaaggattgagcccaggagttcatgaccagcctggacaatatagtgagacctcgtctctacaaaaaactataaaaattagctgggtgtggtggcgcacacctgtagtactagctactcaggctgaggtgggagaatcccttgagcccaggagtacgaggttgcagtgatggtgtcactgcaaaagagcctgagcaaaacagcaagatcttgtctctaaaaaaaaagaaaggattgtccatgtgcatactttgttcattctcatacttcataccgtgctgtcttctttccttagtacttgtacaggaaccactatgataaaagacacattggaagcacagaagaggggcaggtaaattacaatgagggctcagaggcagcttcctgtagagagtggctctcaagttgaattttaaagaacaagcatgagtagctagctagagaatgaggggatagggtgtgtcaagtgggagttaagagccggaggggaacttcagctctggaaggcaccattggcagtggcctgccccattcttggtcccagcacctgcagaatagaaccattctggttctagattttcctgggtaaccttgacccttggggtctggtgacttcatctccttctattccttcagccttaggactggctattggtagtggcttgctgttgttgttaacttctggattatctaagcatccttattggtttctcagctctttcatctctgctctgaagaccgaaaaaaaaaaaaaaaaaaaaaaagagagagagcaggctgtgggaggcatggaataatcaacaccatttctgatgggaaacttcgatgaactgtgaatggctggggtgaaggatgtgtgtaagaggagaggaacaaataaaattagagaagtagagtgttaggtattaagctaaaagccgcagggagccattgaaggattaagtaggggatctgattagcatttagaaagatcattctgatagcaatgtaaagaatgggcttattgcagttggccatgaacagactagcaataagaaaacaaacatgtgggaaactgtttcagtgagggagggtggactagtcagcaattctcaaacattttggccttaggtgctcttcatactcttgaaaattattaaaggctccaaggctgggctcagtggctcacgcctgcaatcccagcactttcggaggctggggcagatggatcacttgaggccaggagtttgagaccagcctggacaacatggtgaaaccctgtctctactaaaaatacaaacattagctgggcgtggtggcttatgtctgtaatcccagttacttgggagactgaggcaggagaatcgcttgaacccaggaggcagaggttgcagtgagccgagatcgcgccactgcactccagcctgggcaacacagcgagactccgtctcaaaaaacaaacaaacaaacaaacaaaggcaccaagatagctgccttagttccagacatcacgtacagacacaacaatgtgatagaggagagatttttccattaatgaatatttctgtttaagagccaggataacctttttcaaaaattcctcagctcactctcccagtgcttaaatcacagaaaaaggaaaaggagctgtgtttggtttaaaccaaccatgattcactccctggagccagggttgggcatggggccagcctcttctgaagcttatagaggctcctactagcaaggacgaatgtgaagagggtaagtgctcttgggtaagcagctgtcagcagctgctacaggattcatcaatgcagaagttgtcagtggaagtctgatgtctactgatgattaaccaaagagtactgaagtcagaagagctgagacagaggacaggactctaaagaatgctgacacttaggaaaatgagcaaagtaaaatgaagctctgaaagaaactgacctgggacataagagtgcagtgattaagagcatgcgctccgaagtgagactgagttaggtgctactaacgttagctgtcggatcatgggaaaatcacttcgttttctcatctataaaatggggaggaattatacctatttcattagtgctgttaagaggttggattaaataatagtaatatgtgtacttaacacagaacccttaataaatgaaggctactctattattagttttaatattcatgaggatctgcttcagagatggaaagataatgagatggaacagaagacaagagaagataatttttaaagtgtctctagtgataaatactggaaagaagtcaaataaggtaaggaccatcatgaaatgattataagtggtcctattcacgtttttagcatctactattggcttatattaaactaacagctagccaaatccacaaaattgcttttacacaaaatccagccaaactagttgcctttctttctgtacctttgtagctaactgcaggatttccattttatacactatgctgtatctaactttttagtctaatgttctagcctggcaagatcagtttgaatctttgatctatctttagtacactaaatggcttttccattgataatgtcatctgtatacttgatgtacgtgtcttgtatatatatattttttttcttttttttttttttgagacagagtctcactctgttgcccaggctggagtgcagtggcatgatctcggctcactgcaacctctgcgtcctgggttcatgccattctcctgccccagacttccgagtagctgggactacaggcgcctgccaccacgcccggctaattttttttttttttgtatttttagtagagacggggtttcaccctgttagccaggatggtctcgatctcctgaccttgtgacccacctgcctcagcctcccaaagtgctgggactacaggcgtgagccaccacgccaggcctgtgtcttgtatatttttatgtaatctttttataacaagtaagtggtaagcatacttaaaaggaaagtaacttttctccaagccgcattcagttttctcatctgtaagttgagtataattaacaggccaggcacggtggctcacgcctgtaatcccagcactttgggaggccgaggcaggcggatcacaaggtcaggagatcgaaactatcctggctaacacggtgaaaccccgtctctactaaaaaatacaaaaaattagccgggcgcggtggcgggtgcctgtggtcccagccagtcgtggggctgaggcaggagaatggcgtgaacccgggagcagagcttgcagtgagctgagatcgtgccactgcactccagcctgggcgacagagcgagactccatctcaaaaaaaaaaaaaaaaaaaaaaagccaggcacggtggctcacgtctgcaatcccagcactttgggaggccgaggcgggcggatcacgaggtcaggagatcaacaccatcttggctgacacagtgaaatcccgtctctactaaaaatacaaaaaattagccgggcgtggtggcgggcgcctgtagtcccagctactcgggaggctgaggcaggagaatggcgtgaacctgggaggcggagctcgcagtgaacgagatcgcgccactgcactccagcctgggcgacacagtaagactctgcctcaaaaaaaaaaaaaaaatgagtataattatattgatttcagataaagtatcataaataagtaaatgcctaaacattcaatcctcaattgaagcctgtatctggcacatagaagatgctcatgaattcttccttgtcacctttttctcctcttccctgtgtcactccttcccttcctttctctttaaatttctttaaacattgctttaatatactgtcttgcctaacaaaagaaactgcatatagaagggtgcattgagatccaactggacagaagagattaaactgaatttcatgctttgagttggtggtggctccctaacgtgaggatagagacacaaataacaaaagatacttctgtctcttttaagggaaaatttttaattcccactcatatactgttgtcttctccaggtctagccctatacctaacatctcctctgggtctcacatcccttctagcccctcaaagcacaccatagttatttcacgactaatagaaaaatatgaatttagtatcaacaataggcacagcatcaaattaggaccaaatatatgattctagaggcagaaaacaacctctctgccacttagaacctaatgaactctagtacctgggtttaattcttttagactagagtctccattttcctgaaaatctactacctcatcctaacaccctgggaaaagaaagaaaatttgaggaaccttcgggattcctgccccctctcctgggtaatatggtcatgccattgatgtattctgtcacgctgtcaacaaacatttattaagcccttattatgtttcaggcacatttataaatactagggatgctgggatgagcaatacagacaaggttctcatgggttttacattctagagggggagacaatcacgcagaaaaatataccaacaaggcaatagtagaaataagtaagctgggtgcagtggctcatgcctgtaatctcaatgacttgggaggctgaggtgggaagattgaggccagcctgggcaacatgacaaaattccatcattacaaagagattaaaaaaaaaaaattagctggatatggtgacacgcacctgtagtcccagctactcaggaggctggggagggtggattacttaagcccaggagttctaggttgtagtgagctatgattgtaatcatgccactgcacaccagccttggtgacagagtgagaccctgactctgaaagaaaagaagagaagaggagaaaagaaaagagaaaagcaaaacaaaaacaaatgtgatatggggcatttgaacagatgacatgctgtggggatcgtacggctcctttagagtaggtgagcaggaaaaccgtctgaacaggtgacatttcagctgagacctgaattacaagaaagaacaagtcacagtaaaatgtagagaatattccaggcagaagaaacaccagcacaaaatccctgagatggggataaaactgctgtgttcagagggttgagaggaagaggagagtggtgtgtgataaagttgaagggccagggtcaggtcacactgtcaggacctcacaaacctgagagctgtttagaatttcctggggagctttaagaaacatgtggggccttcctccagagattctgattcacttgatccaaggtggggcccaggcatcaaaagatcccaggggattcctgtgtgcaacctagttaagactcactgatgtctggggttcacatgccatggtaggcagcctgcattttctcctaagtgggatgggaagtcactaaagggtatggaagcagagaagtgatgggatttgagtgatttatttaaaagatctccctagctgctgtaaggagaatggattgtaatgaatcaagaaagaaagcaggccattattgttcaagtctttttggagacatatgctttaattcctcttgggtaaatatttacgaatgaaattgctggaaataccccaatgtccatcaaaaggtgactagataaacaaattgtgatatgttcatacaataaaatactactcagcaataaaaataaagaactactgatacacaaaataacatagatgcatctcaaaaccattatgctgagtaagaccagccagacacaaaacagtatatgctgtactatttcttttatgaggtttaagaagaggtaaaactaacctatggtgatagcaatagaagtggctgcttctaggggcacaaggattgactgaaagagggttactagggaatttatgagggtaataaaaatgttctacatcttgattatatgggtatacacgtttataaaaactctttggatggtacacttaggattggtacatttcactgtatgcaaatttaaaaaaaaaaagaactactacaactacacacataataaaatggcttaaaaaagaaaaaaaacaataccaagtgctggagaggatgtggaaatcccatgttactgatgggaatacgaaatggtatatctgctttaaaaaatagtttggcatggtggctcatgcctgtaatcccagcactttgagaggctgaggagggctgatggcttgagcccaggagttcgagactagcctgggaaatatggcaaaactccatctttatgaaaaatacagaaaattagccaggcattgtggtgcgcatctgagtcccagctacttgggaggctgaggtgggagaatcacctgggccggggaagtcgaggctgcagtttagctgtgattacgccactgcactccagcctgggcaatgggagtgagaccctgtctccttaccaaaaaaaaaaaaaaaaaagtctggcactctttctctttttttttgagatggagtcttgttctgtcacccaggctggagtgcagtggcgagatcttggctcactgcaacctccgcctcccaggttcaagcaattctcctgcctcagcctcgtgagtagctgggactacaggcaaacaccaccacgtccagctaatttttgtatttttagtagagacggggtttcgccatgttggccaggatggtctcaatctcttgacctcgtggtccacccacctctgcctcccaaagtgctgggataacatgcatgagccaccgtgcccaacttctggcactttcttataaaattaaacaggtacttaccatatgacacagcaatcttacttcttggtatttactcaagagaataaaatatgtcacagaaagacccttatgtgacggtttacagctgttttattcacaacagttgatttttgaaaaccagagaaaagcatcagggattacagttgggagactatggcagtagtcctggtgaaagacagtaactaggtctaggctgctaggaatgaagatgaagagaagttaacaaatccaggatgtatctggagagagagtctaaaggcattgccaatggtgtgagaagaagaaaggaatccagaatgactctaaggtatttggtatgagcaactggatggatgatgatgccatttatggggctgtgaaagaatggggaaagtaggcgaggatagacaaaaatccagggttctcttttagccatgttaagatggcttattagacttcacaaacagtggagcagtagatttgggaaaaagatgcctccatcttttattgttagaacataaactgtcaatctggtgactaggaggaggctgtgatgataggtggcagcagaacgccacgctttggagttgtgatagtgtgtcaggaataggctgacaagccacagaattaggtatgatctagaatctctgtagaattgtggacctaacagatagaaggaatagaaaaagaattcaggatgagatgaaacaatcaatagcttaatccaaacaaatggtgtaatcactgaatggaggtttataggagctaatcaggcttggaaattagataatgatatgatttaggttcaaagatgtgggctaatgtgagcatttcttattagttatgtattgctatgaaacaaattactccaaactttagaggcttaaaacaataataaatgtttataattttacagggattctgtggattaggaatttaggagctggccgggagcggtggctcaagcctgtagtcccagcactttgggaggccgaggtgggtggatcacgaggtcaggagtcaagaccagcctggccaacttggtgaaaccccgtctctactaaaaatacaaaaacaaaaattagacaggcgtagcggcaggcgcctgtaatcccagctactcaggaggctgaggcagagaattgcttgaacctggcaggcagaggttgcagtgagccaagattgcaccactgcactccggcctgggtgaaagagcgagacaacgtctcaaaaaaaaaaaaaaaaaaaaaaaaagaaggaatttaggagctgcttgatgtttctggtgtttccttgttgttgttgctttgggggaggaagagggcagaatggagtggctcatttttaattcaggatccctcatgaggttgcagtcaaaatgttggtgtgagctgcagttatctgaaagcttggctggggctagaggatctacttcccagatgggtgattcatactcatggcaagctaatgctggccattggtaggaggactcagttcctcactacatgactgctccacaggagtgcatgagtagctggcttcgtccagagcaaatgatccaagagcatgcaaggtagaagtagaaatgtttttgatgacctagcttcagaagtcactctacatcatttccacactgtcttattgattttccaggtcagccctgttcagagtggaagtatccacccaagggagtgactatgaggtgtgagagaatctctgggggttattttggaggctggctacaactcctttttaagttctaaagttcatgtcatattaagagtaaaaggaactcatctcctggtagtggtgttatgaacagaattccctaggtatttgtttatgtttgtttgttttgagacgaggtcttcctctatggtccaagctaaggtgctgtgctcactgcaggtttaacctcctgggctcaagtgatcctccaaccttagtctcccacatagctgggatctcaggcgagcactaccacatccagctaatttttaatttttgtagagatggggtctccctatgttgtccagggtggtctcaaactcctggactcaagtgatcctcccaccttggcctcccaaagtgctgggattacacgtgtcagttaccgcatttggcccccgtagaaatatgtggctctagacttcgtgcaataccagctttggaaggtatattcaaaagaatttgagaaaaatcttttgttttttaaagcaataagtgttttattttattttattttatttgtttgttttttgagacagatctcactctgtcacccaggttggagtgccctggtgcgatctgagctcactgcaacctccgccttccaggttcaagggattctcctgcctcagcctcctgagtagctgggattacaggcacgcaccaccatgcctggctaatttttgtatttttagtagagatggggtttcaccatgttggccaagctggtctcgaactcctgacctcaggtgatccgcccaccttggcctctcaaagtgctgggatgacaggtgtgagccaccacacccggcttaaagcaatatgtattttaaacctaggtaggttgacaattaaatatagaaatgattaagaaaatcaaacatgctgggcacggtggctcacgcctgtaatcccagcacttcggcaggcagaggcgggcggatcaccaggtcaggggatggagaacatcctggctaacacggtgaaaccccgtctctactaaaaatacaaacaaaacaaaacaaaaaacaaaaaaacattagccgggagtggtggcgggcgcctggagtcccagctactctggaggctgaggcaggagaatggcgtgaacccgggaggcggaatggcgtgaacccgggaggcggagcttgcagtgagccgagatcgcgccactgcactcccgcctgcgcgaaagagcgagactccttctcaaaaaaaaaaaaaaaaaaaaaaaaaaagaaaagaaaaaagaaaaatatattagtcgtgtagtacttatttaaaacatatgatctaagtaattgacttacatttgtgattttaagtggaaatatttcaaaatgtaaatgtaatattagacatttaaaagaacctaaaattaacatatttttaagattaatcgattgcatatatatgaatcacataaatacttgaaaaggaatttttgtcagtcatacaactgaagtacttgacaaaataaattaattactttaagtttacaaatgcagataaaatacttaaagtaggttaagtaaatttatttatttatttatttatttaaaaaaatttttttgagacagaatttcagtgtcattgcacaggctggagtgcagtggcgcgatctcggctcaccacaaactccgcctccagagctcaagtgattcttctgcctcagcctcccgaatagctgggataacaggcatgtaccaccacgccaggctaattttgtatttttttggtagaggcaaggtttctccatgttggtcaggctggtctcgaactatccacttcaggtgatccgcctgcctcagcctcccaaagtgttgggattacaggcttgagccaccgcacccagcctattctgtatgtttttattttatttatttatttttttgagacaaaatttcactcctgttgcccaggctggatggagtgcaatggcgtgatctcggctcaccacaacctccgcctcccgggttcaaacgattctcctgcctcagcctctccagtagctgggattacaggcatgtgccaggatgcccagctaatttctatttttagtagagacgcagtttctccttgttggtcagctgctctcgaactcccaacctcgggtgatctgcccacctcagcctcccaaagtgctaggattacagatgtgagccaccgcacccagctgtttttattttttttttagatagagtcttgctgtgttgcccaggctggagtgcagtggcgtaatctcggctcactgcaacctctgcctccccggttcaagcaattctcctgcctcagtctcccaagtagctgggattacaggcatgtgccaccacgcctggctaatttttgtatttttagtagagacagagttttgccatgttggccaggctggtctcgaactcctggcttcaattgatccacctgcctcggcctcccaaactgctaggattacaggcgtgagccaccacgccccaccaattaagtaaatgtataaatttgaccaaacattaatcaaaaccctcctcaaaagtgattaaatttagctatatctgtacaatttataagttgaatttataagcttacagaaaaatcctcgaaggttttgattttgtaaagtcaaatattaattttcaaagccaggcaacttctgaataatttctttctttttttcttttctgagacagagtctcactctgttgcccaggctggagtgtagtggcatgctctcggctccactgcagcctccatctcttaggctcaagcaatcctcccacttcagcctccagagtaactgggactacaggtgcacgccaccacgctgacctgaatattaataattttttctatttgcaaaagccgcctttgagggaatatattgaattggatggcagataaggaaggggaggttggggagagattttggctgatgggtcaggccctgactgaataagcttgggcctgtctctagctgccttgcgaggctagctgctccagtgctatgagcccctcagtgctgaagccgcaggatgggggaagggaagcagaagccatgcccctgtctgggtttgtctgtccccaggaaccccttgtcctcactgtgctctgtgcatgtaataaatgatgcactggccttaataccaattcacagcatgattcttgtctctccgaaggagctgagcccgtggcgtaatggtctttctttattaacttgctctttgatcgtccaagggactcctaactgacctgcagaactaattgtggctgtattaagcaaagagtacagtaaaaacccaaagaggatcctgagcataagagctgcaaattcaccacattgtagtgacatgactgatcaatgtacaatgaagacatagccaaacactgattaatagtgagtggcagagcctcacatttcatttttggttgtaatatattactgttttaaaatttgctataactgggccgggtgcagtggctcacacttgtaatcccagcattttgggaggctgaggcctgtggatcacttgaggccaggagttcaaaaccagcctggccaacgtggtgtaacccgtttctactaaaaatacaaaaaaaattagccagttgtggtggcacacacccgtaatctcagctactcaggaggctgaggcaggagaagcgcttgaacccaggaggtggaggttgcagtgaaccgacattgtgccattacacttcagcctgggcaacaagagtgaaactccaactcaaaaaaaaaaaataaaaataaaaataaataaataaataaaacttgctgtaactggtcttattcctaaaccccctgcccagcttggatgtggggcaagagtgttcttaaatttcctgttaactgtatttttctgtcttctatcaaagtccaactctcagttggtgctcttggcttgggatggtgtccagatgcaggaaggaagtctcaaaagcctggagtgctggagtgaggtggcctgctctccacactggcacgtgcgaggttcccgactttgctgcccttcacgcagttttagcaaccaaagatgagctgccctgacctctgggttgcaacttttctctgcaggcctcctcttccccacccaggccctgccagaccagcagtccggggcacagcttcaaagcacagctccgacattcagggccccgatacagtactgcggtctccagccacagccgttcctggctggcccagtagataaggcttattctcaaatcccacccagggtagccagcaggctcaggtcacaagtccaggaatcgctagccgatcaaggctagaggtaccgcttgtctgataagtgacccagaccacgggtggaatcttggcttgacaagacccactgcctttctcctcccccaacttcatcttcgcagtctaactatactggattgggtttcccatttggcagtaaaacttgtgcactcagccctgaatcactggtctctcagcatttttctccgtaacgcaggcaaaagccccgcagctcttgtcatcccagtgggtgatcgcccctcctgatccttggcattgtgccaaggctcctttttccctacttctgtctcccactccttcctgcagtactcagggcctaaatggatgaacttctggcaggatgtcttcactctcgtcactaacgtccaaggcccagccacgatggtagaggggtcttcactacattatgcgagaaggtgtaatacaaaaaattagccaggtgtgatggcgggtgcttgtggtctcagctactcaggaggctgaggtaggaggattgattgagccaaggagacagaggtttcaatgagccgtgatcgccactgcactccagcctggatgacagaacaagaccctgtctcaaaaaaataatgaaataaaataaaataagaggtgcagtttccagcctggccagtatggtgaaaccctgtctccactaaagatacaaaaaattagccgggcatggtgacgtgcacctgtaatcccagctactcgagaggctgaggcaggagaatcgtttgaacacaggtggcagaagttgaggtgagctgaggtcgcgccattgcactccagcctgggcgacagggcacgactctgtcccagaaaagaaggtgtggtttgagcccatcatgtgagttgagaatagtagaaactgggacctatactgggactcaaaatacattagcattatatgtgcaattatatttccattgaaactaactttacatattaattggacttttgagggggtggggagggggaattatatttgacaaagagttactgcctgactgtcatgtgcaaagtactggaccctgtctacaatgacctgacaccttggagaggaggggaaacatgtttataagtatcttcaaagaaaagacagggctgggcgcagtggctcacgcctgtaatcccagcactttgggaggccgaggcaggtggatcacctgaggccaggagttcaagaccagcctggccaacatggtgaaaccctgtctctactaaaaatacaaaaattaggtgggcagggtggcatgcgcctgtagtcccagctactcaggaagctgaggtagaagaatcgcttgaatccaggaggcagaggttgcagtgagccgagattgagctactgcagcactccagcctgggcgataaagcaagactccatctcaaaaaaaaaaaaagaaagaaagacagaagatggcaagtgctgtaaaagaaattcaaagtatcatagaagcctggagatgggtgggatgaattctgaatcggtggacccaggaaggcttcaaggagcatccataaacatctgaggcttgcttagggaaagagaatataggaaggaataagatatactgtatctgcttttgagaattcatgttctagtggcaaagactgacatgttttgtgggaaaggtgatgtttaagccagaccttggaaggcatgtacaatttcaacaagcagagataaagaataagagaaagagggatttccagaaaaaggaaagcatgaatatcacagacctatggtttctttcccttcccaccccagcaccacttcatccacagggatgaatcatcttctccataccatgagatcccacctcctgaccacatagtattggctattgaatattggcagaattcttacccagcaaaccaatcagttcttccctgagacttttggaactgaaactgagaaaaagtagtcaatttccctttgggtatgaaagataaacctggaatctactgataactatgactttgagaatgcatggagagagaccgagagagaaacgagagagagagagagagagagaggagtgagagagaggaaaagagagaaaaaattgaggcagatacaaaggagagaaatgtcatagagagagaacactggtggcctgtgtgtctctgattctggacattcatgagtcttagctgcatttctgaccttggattccctggaatacagtaatatctttatgatacatttttatttttccttaagctaaattgaggtttttgctttttcttctttgccactaaaaaattcctattgtattattatttatttatttattttggtaaagggtctcactctgtcacccaggctggagtgcagtgagctagatcatggctcactgcagccttgacctcctgggctcaagcaatcctcccatctcaccctcctaagtagctgggactagaggatggttaatttttgattttgtgtagagacagggttttactatgttgccctggctggtctcaaactcctgggctcaagccatcctcctgcctcagcctcccaaagtgctgggattacaggtgtgagccaccgcacccagcctgtattagttttctacaactactataacaaattacctattgttataggcttgaaacaatagacgtttattctcttacagttctagaaggtggaagtccaaaatcaaggtgtccacagggccgtgctccctctaaaggttctaaggaggaatcctttctcgacaatttctagcttctggcagctgcctgtaatccttggcattccttcgcctatagctgcatcaccccatttctacccccatctttacatggctgtcttcactctgtgtgcctctctgtcttcaaatggcctttcttcttcttcttcttctttgttttttaaatttgagatggagtctctgttgcccaggctggagtgcagtggtgtgatctcagctcactgcaacctctgcctcctgggttcaagctattctcctgcctcagcctcccaagtagctgggattacaggtacgtgccaccacacctagttttgtttttgttttttgtttttgtttttgtttttttttcagtagagacagggtttcaccatgttggccaagctggtctcgaactcctgaccccaggtctcagaggtctcagcctcccaaagtgctgggattacaggtgtgagccactgcacccgaccatggcctttcttctaaggacaccagtcattgattttggggcccacactaatccaactagacctcatcttaactcacgacatctgcaaagacactatttcccaataaggtcccattctgaggttctgggcagacatacattttggaggaatgctgttcaactcaggacactgcttcaatgcacaaaggtgccggggctgcaagttcagatcctgtttagagccaggtactcagaaacctggagtgttgtgccggggagttggggtttgctctctacctagtgaggaggcatcaagtgtcctggacaggatagtatcatggtcctagtttcatggaggactgctggtcatagtgtgtaacctaacttggaacagggagggataaagaagcaggaaaaccggccgggcacggtggctcacacctgtaatcccagcactttgggaggccgaggcgcatggatcacctgaggtcaggagttcgagaccagcctggccaacgtggctaaaccccgtttctactaaaaatacaaaaattagccgggtatggcggtagcgcctatagtcccagctacttgggaggctgagataggagaatcgcttgaacctgggaggcagaggttgcagtgagctgagatcgcaccattgcactccagcctgggcaacaagagtaaaactccatctcaaaaaaaaaaaaaaaaaaaaaaaaaaagcaggaaaaccagttacactattcaatgtcaggtgaaaggtaatacagtgcccagtcaggatagcaggtgtaggaatgcgtagaaagggacaggcgggagacacaccacagatccagagttaaccagactcggccatttttaacataattgtatggtggggtgggaggaagagagtgaagaaacggaagaatttagatgcattgtgcaatatgggggtccataaacatcatcgaatggttaccagatgagagatgatatgacctgaagggctggtatgtaaagagaagggcaaggcttgaggatcacagggttgggcccccatagacattgtaagaggggtcagggagttcaaaaggcgttccctccattttgattatttacatgaaaattattctgtgctttcatatgaggagtctagagcatagtccttacctgcttttattttctttaggaaaaaaatttttgatactctttgcttacatcaggcttcttgtttgaatagtatatttttttatttgaatagatactgccagattacttttctaaaaggctataacaatttacttttccactggtaccacatgagtttcctttcttccttttccctaccattagtaggtatttgcactctttaatttttactatttgaaaatgtgacttggagacaaagtcttgctctgttgtccaggttggagtgcagtggcgcaatctcggctcactgcaacctctacctcccgggttcaagcaatcctcctgcctcagcctcctgagtagctgggattacaggtgcctgccaccacgcctagctaattttttgtatttttagtagagagggggtttcaccaagttggccaggctggtctcaaactcctgacctcaagtgatccactcgcctcagcctcccgaagtgctgggattacaggcgtgagccactgcgcccagccaaaatgagaatttttatatataaatctttgtccatccaatgatgcttacaatgatgtttataattagaaagatgacataggtgaagttttctcagattctttactttgttgtttgtcttcctgtgtgactttctcccacttctttgctaatattttaggtggatagggagagatatgagaaagggaaagggttaaatcaaataaatgttttattatctttgaattatatttatatatgcctttcctgtccttcattacaaagtgatctagaactgctgttaagtcattattagttctctaattttaccttatgcataaaaaaatttttcattttattgagggaagaacaaatgcaaaagaatcctaacattatctgtaacctacaaaagcagcttcttgactcttcttgactctttcttttctttctttctttttttttttttttgagatggagttttgctcttgttgcctaggctggagtgcagtggtgtgatcttggcccactgcaacttccgcctcccgggttctagtgatcctcctgcctcagcctcctgagtagctgggattacaggtatgtgccactatgcccggctaattttgtattttttgtagagatggggtttctccatgttggtcaggctggtcttgaactcccaacctcaggtagtccacctgccttggcctctgaagggttgggattacaggcatgagccaccacgcctagcctgactcttttccttagacatagaaattctgaaaagcatcaacctttttttaccacagtgaaaaaaaaagatgagatttatatctcaataccatgaatggtttatataataatatatgagtggataaataaacatccttttctacagtcttctcctttaaactttggctattagagtcagaatgcttcaattgcagaattctcacttgagcaaagtttttgtataacattattcatattcttggccttggatagcaattaagtctctcaagtctaaaattgctttgtttgctttttaaagaaatctgcccaccttacagacctacaagttaactaaccagcctgtttttcccccaagaggacttcgctctgttggtttcttgccagctcttactttcaaattgaaatagttcagtttcactgtttctagaacatagaattcattacccatggatttttgccaacaatgtccctctcatgttttttaaaactaagatgaatgttacagagtgacctagtggactggatccacgactagaaatcaggcagtgatatattagatgtgtgcgtggatgctccattctgggtagtgaggtggctagggggatgggattctgggagggtgaggagggcattcagggtgaagccttcaggactagagtggagaaatatgtgtgagagattaggtaagatttgacatatgtgaggcaagacttagattcttcccttgccctcaggtccctggcgggtcgctaccacagatagggcacagtcatttattccttttggtcatttgggtagaaaacagatagccaggtgacagagaatatttataaagggctctaagaagaaccattcctctgttgtttccattttctcttgctacgtctgcagctctgcttatccctctgtttctactagtcctgaaagggcatgccttcctgcaacagaacagaaatctcaggaatgtatacatcagcataacctatggccaacatgaatttttcattcatgtggctctgttgaatgaaataacgaaattcctttatcttttaggttactttctaagtatttttaggttactttctaggaatatgttagtgtttaaatatttttctcttctgatttactatatatatatatttaattaaacttttaattgtgagataattgtagattcatatgcagttataagaaataatgcaggccgggggtggtggctcacgcctgtaaccccagcactttgggaggccgaggtgggtggatcactttaggtcaggagttcgagacgagcctggacaatatggtgaaaccctgtctctactaaaaatacaaaaattagtcaggcatggtggtgcacacctgtagtcccagctactcgggaggctgaggtgggagaatcacttcagcccgggaggtagaggttgcagtgagccgagattgcgccattgcactccagcttgggcaactgagtgagattctgtctcaaaaaaaaaaaaaaaaaaaaaaaaagaaagaaagaaaagaaaagaaaagaaagaaggaatgcagctgaagccagaagctacctattgggtaaggagtgctctcagcacttaagaggtttttttaaaaaaaaataataaaataatgcagagaaatctcatgtaccatttaccctgtttcccccaatagtaacatcttccaaaactatagcacaatgtgacaacaaggatattgacattgacagaataaagatttataaaaatttcatcatcacaagaatccctcctgttgctcttttacagatgtgtacacttctctccttcccgagcccctcgttatccctggcaaccgctagtctattctctatttctataatgttgccatttcaagaatgttaattaaatgggaccatagagtgtgaaaccttttggtattggctttttttaactcagcataattcctggagattcatgtatatatcaatatttaattgttttttagttctgagtaatattttgtggtatgtactacagttcgtttattcactcattgaaggataagtgggtcatttccagttttttggctattatcattaaagctgctatgaatatttgttttgtgtgtgtgtgtaagatggagtctcgctctgttgcacaggctagagtgctgtagcatgatcatggttcactgcaatcttcgcctcccgggttcaagtgattcttgtgcctcagccccccgagtagctggaattaccggtgcccaccaccatgcctgggtaattttggtatttttagtagagacggggttttgccatgttggccaggttgttctccaactcctgacctcaggtgatccgcctgccttggcctcccaaattgctgaaattacaggcctgagccactgcgcctggcctgctatgaatatttgagcacaggcttttatatgaacatagattttgtgtctctggaatatatgtcaaagagtacaactgatgggtcatgtgggagttgcatgtttagttttatatgaaagtgccaaactgttttcaagaatggttggaccattttaagtttccatcagcaattatgagttatctagtttctctacatccttgtctgcatttaatgttgtcactatttttattttagccattctgatagtaactgtagtgatttctcatcgaagttgaaatctacattattttcctgatggctaatgatgtcggagaccttttcatgtgcttatttgccatctgcatgtcttctatgaaaatatctgttcacgttttttaaatcaattttctaactgaattattcgatttttttttaatttttttttttattttttaagacagagtcttgctctgttgcataggctggagtgctgtggcgtgatctctgctcagtacaacctccacctccggggttcaagtgattctgctggctcagtctcctgagtagctgggactacaggcacgtgccaccacacccagctaatctgttggatttttagtagagatggggtttcactgtgttagccaatggtctcaatctcctgacctcgtgatctgcccgcctcggcctcccaaagtgctgggattacaggcgtgagccaccgtgcctggcctatttgattttttaatttttgagttttgactgttctttatatattccagatagtagttttttgttggatttgtggtttgtgaatattttctgtagcttgtcttttcatcttcttaataggatcttttggagagcaaagttttaattttgagagatccaatatatcaatatttccttttatgggttgtgctatcgcaatcaagtaaaagaactctttgcctagctctagatcttaacatttttcccttatttttttctaagagttttatagcttacgttttacacttaagtccatggtcacatatttttaagtaggtgtttagatcctgcttgacatgtctcatgtctgaaataagccttagcatgtggaattctttctgtcctcattttttccctcaagcatctactgagtgccaactatggctcaagtcactgataccaaatcatgtgtacaattcctcattagataaatatttcagactttgcaatgagtcaattgagtgatgtacttcagggcgtggcctttggaacccaactagcttggtcaaacctggtgccacctctcagcagctttgtgatctttagcaagttacttaatacctctgaaactcaatgtttcacatcattcacatctcgatgaaaataataatacctacatcacaggattgttgtgagaagtaaatgaaacattatgtgtaaaatgcttagcacactgcctagcacatacatagaaaacattcaataatttttagtcctcctccttcccatccccccatgcaaagatttttctggataccttccccaactcatcatctgcttccccagagtctccaattctttctctctacttctggtcttaattattctacttcttttattaaacaacattctcaacagactttggcatttgataggatttcctatctccaatttgtttgtggtattcttatatgtgtcaaactatctttgtttcctgtatgtgttatgtatctcaccaacgacatatctcctcaagggcatgccatggccctagtcttccatagagtccagctctatgttgggcaagtggcccctaatacactgacagtggagaatctaaattaaaacattttgtagaaatgtttttgtagaaagcaatttttcaacttctgtggaaagcaattcagcaaaatgaatccaaaacattgaatactttgacctagtaatttacctttttcagaatccatcctaagaatggtcagatacttgaataaaaaaatttatatatggctgggtgcggtggctcacgcctgtaatctcagcactttgggaggccgaggcagtcggatcacctgaggtcagtagtttgagaccagcctgaccaatatggtgaaaccctgtctctactaaaaatacaaaaaaaaattagccgggtgtgctggtgggcgcctgtagttccagctactccgcaggctgaggcaggagaatggcgtgaacccgggaagtggggcttgcagtgagccgagattgtgccactgcactccagcctgggcaaaagagcgagactccatctcaaaaaaaaaataaaaaataaaaataaataaataaataaaaatttagaaaaatgtaaatgcatactaattttaaaaatcaggaatcagagtcccagcacggtggctcacgcctgtaatcccagcactttgggaggccaaggtgggcggatcacctgaggttaggagtttgaaaccagcctgaccaacatggagaaaccccgactctactaaaaatatgaaaattagccagatgtggttgtgcatgcctgtagtcccagctacttgggcggctgaggcaggaggaacgcttgaacccgagaggtggaggttgcagagagccgagatcacaccattgcactctagcctgggtgacagagcaaggctctgtctcaaaaaataaaaataaaaaaaataaaaaaataaaaaaaatcaggaatcagggtaaattccatttatagatggaatattataccatcagtacaattctgtagctataaatgctgggtaaggtgtcagagccccgacattgggaagtggcggactagcaggttggtaaaaagaatgtaccgacaacagtataggtttgaaaaaggaaagtttattagaaagaaaacactgcagaagagtgtagctgagtgcctcagcaagaggactgagtgcagtggtggatttttccttaggagcatttatgggtaatttggaccacattagccatgtaggtcatgatagatgattccatttgtagacattttggtgccttaatgtcagcaaggcttgcacaacgagttttggcatggcattctggagatgtatagaaattctagttacttataaatttttttgagggaaagaaatctgaaaccagatgcctgctttagataataaggaagtcgaattacttctaattttccccagagaaggagttttgcctctggatggcctgtttgatagtcaccaggtggtgtttgctcccttctaaattccccaggtaaggagtttttgtctcccgggcctgttcaatggccaccaggtgattttgctctcttcaataaggatatacactaaagcactctttatactagcaaacatgtagaaataatcccaaagcccaaccctatggataaattaaactgtcacaaaatagaattacagtataatcacatttgttttaaaaaacttaggtacatatggatgcacttacacaaacatacaaaaaccaggaaaaatatacaacaaaattttagtggtgatagtctgtgactaaaagatttttggtgattttcattttaagtatggcttctttaaaacataatatttggccgggtgtggtggctgacgcctgtaatcccagcactttggaaggccgaggcaggtggatcgcttgagaccaggagttcgagaccagcctgggcaacatggagaaagcctgtctctactaaaaatacaaaaattagctgggcgggatggtgcatgcatataatcccagctacttgggaggctgaggaatgagaactgcttgaacccgggaagcggaggttgcagtgagtcaagataacgccactgtactccagcctaggcaacagagcaagactgtctcaaaataataataataatatttattacttttgccataagaaaacaagaatgaaagttacaatctgtttttaaaatagtgttttagagactatttaattacatggatataatgatcattcatctcattcaaaacatttattaagtgcctaccaactgttaggcccaatgctagggacacacggagggcacaattaacaaaatctttgaatcacagatagtctaatgagggatacaaaaaatttacaaaacagtgagagaagtgacaatacaggtatagtgctgagtgtcatggaagcatagagaagggtgggagttagggaggtaggataaggttttttgttgaaacttgaatgagcccaaagaaacattgtaaatagggaagaaatacccaagcttaggtagggataagcattttcaaaatttctcaagggattccatgaagaaaagtaaacaggcatgggactggaggagagtttggaaggaaggctagcaaaagtgagtaggaatcagaaaatcagttccgtatagtctatgttgctgagtttggactttctatccttaagagtaaacaggaaaaaaaaaaaaaggaaaaaaaaggaattaaaggctttaaatgggaatagcatgatcatttatgattctgacaaatgacatggactttgctctaaaaagatcacactaactactgagtaggaaatgatttggaggaagataaggctggaggcaggaaagccagttagacagtggtttaggtcactgagaggatgaccctgtctgtagggatggggagatgaaacttgatgtagaagtgacttgatgatagtttgaattgctgacagtagtggaggaggtgtcagggaaaagcaagagtcaagaatgatgttttggctctcgggttggcaattgcggatggtggtaccactaactgagactggagacagatgaagaggcacaaagtgggagggaaaatgagttcagattgggaaacactgagtttgaaatgcatgtgggaagtctaagggaatgttcgggaggcttttagagatacaagtctgaaagtcaggtgtgaaactggctgtgtagacatgtgtttggggggtcatgggagtagatgagatcacacaagggatatatgtagaattagaggatggcttaggacagaactctaaagaaaaccaatgtttaagagactgaaagtgagaaagaaaatggactcaaacctggtctgggacagaaattttttgtgtgatgtaatttacaactccttctgggaagcaattagcattcctcataaagtgcgtgaacagttttctgacagactttaataagactgaaaactccttctgggaagctagggttacccacccagctgattgactagcctaataatctttaaccagatgttctttttttttgtacccattctaaacatggttagggaaccattcttttttttttttcttataaaatatctcaaccaaaattactccttcggttggatttttcaaaaagcctctttctcatgtgctcaaaaccaatttgtcagaaacactaccttaacaaaaaagaaaaagaaatctgcaagggaatgagcagaagccagagaggtaggagagaaatcatcagaatgttggtgttatggaagccaggtgaaaataagaaaacagggcatgaatggacaacagtgtgaaatgctggtgagagttcaaataaaacaaggatgagaaattgccatgagatttagcaataagaacatcaatggtgatcttggcaagagctgggtggggtgacagagagcataagtcagatttcagtatattcaagtgtgagcgtagaccattcttttaaaaagtgtggctgtaaaggggaagggggcttttttagtggggaacataagtatatttaaatgtgtttgagaaggagtgagtaggaaaagaagaagggacctgagagagaagggctaatcttgagtttgagaccagcatcttgagtttcggtgtctcagggacttgggaggggaatctgggcacaagtggagggaaggtcagcttcccacaggaaagaagagcaaggatgggcctgtaaggaagactgtctgcaagtttggtgccagaagctgaagctgaaggcattcttgttcattggcttgttacctccgtgatagtgacgtaggttagaagctccagtgaaagtgctgaggcaggtggcaggagaatgcagactgaactgactaggaaaacagagtgatttcagggcattgtggaggtgggggataatgagtgtattctggaaccaatcagcacagatctgtgactttctccagtagcttagaagtccaaattcagcaatgaagaaggctaatatgtttgaattattctaggactgtcttcaaggaaaccattgcagctttgcagcttcctttgcccattctttaaatgcttctttttagtttctagcctaggctctgttttcttctcactttatggaaacgtcctattgatctcatccactctggtggcctcagttaatctctctatgctgatggctcctaatccaatatttgcaacccagcctttctctccagtaccagatttcttctggttcccatctgccttctggggcatcttcaattgggtgtctcctgggcacctcaaattgaactcatcatattcccactgtctccgagaataaaagtaaacactagaaagacaggggtggatttgtgtctaccattatagatcctgaactcagtgctcaatgagcaactgttggttgagtaaaaaaagaaatccactcagttctctaagccacagactttggagtcatcttttactccaacttctccttcatctctgacatctaacccatcaagtcttatctacatttaaatatgtttcgtggcagaaacacacacactccctccgacatgcacacacacacaaaagtgaattttcaagcagttttaacacagaaacttagctgctttacctccttttttttgcttcattaacattagaactaaaccagtgggagagtacctccctccctgcttcctctcccgcctccccaccaagccagctctgccttagagaaaagtgaacctggttcttcatttgctaatgatttgggctcaggttataatgggccattaaggtgaattgtggaagaaagtggggaaaaatgaagctttcaggtggagggataaagaaactatggggtggtgaccccaggatgctagggagtcctgggatctgatccaggccttttggaagaagaggggttggagcaggacccctatgaggggcccgagtcctccccacgcaccgtcagggaggcctcctctgctcagccatgctgcttgagcctcagctctgggtgctgggagaggacttggatccccctgtaccaggacttccacctactcactgcccatcaggagctttgcttgtttcccctacatgttgctttctgccccaaacactgcctctgccttgtggacaccctcctgacatgccccagggactctgtaaaccccagagacatcccccaggtaccccttagagcagcagctccagaactgggggagctggaggcctctgaagagctgagacagtgttaacgatgccctcatcacagggtggtttgtttgcctatctgcactccacaatcaacaatgatagttcagcctgccttcaactgtcatctagcctcctaactaggcttactctctccagtctacaaacccgccgccctcccaacccatccagttccctaccctgaagccaaagggcttgtaaaaagtcaacatttggcccccatcctcctcctcctcacctggctgatgccttcgggtttcagctttagtgtcacttatttttagactgacgtcttctctgaccaccctcttcccaccaggcagatcaggtgtatgctatatgcctcccccaaaccctggagtttattgaaatcactttttaatattttctactggcccgtggacaaagaataggcctacttgcctgttttaccttgtctccagtgcctagccagccctgtgcctgggacatactaattgcttaacacatttgtctgaggaatgaagaaacattagacaagaaagttcagaaaacagttggttagaggtggtaggtgggagtgagacctacataagtgtttttctgattgagtgtggatcagaactaccaggaagggttgttaaaacacagattgccggatcccactttctgtttcagtaggtctggggtggggctggaaataatgcatttctgacaagttctcaggtgctgctgctgctgattagagaccttatgagttacatccgttctgttgttggtaagaaaaggctggaggggtagatcagaggactttcagataaaaagaagggtaaggtgggatgtatagactttggaaatctgaaaggtagtggtcaaaatgggagatacttgagtttgataataaagatggcagaaatttccagtagttgacaaggtccagggagagtagctatgagaatgaatagccaaagtaacctgtggaggaaggtataataacacagagggggtcaaagacctgaaatgcacaaacattgcataaaagtatttaatacccaaatggaaaaattgaaagatgtaagtgaaaaggaaggatgtaaaatggaatgtgtcgcatcattccaattttaggaaaaatgcatagaaaaaagaccaaaaaatggacaatgtttataatagttatccatatggttgagttttattacttcatttttctaaattttcaaaatttcattatcatgtattcctttcatgattagggaagagctttacttattttgaacctcctcagctttggtcatttccatctggtggaattatctcctgttatcccatttcatacttacttctctttgacatttttactttcactaaaagtatggaaatcaacaaaattaaaacaaccaaaatgaaaagcaagcaaaggaaaacaaaaagaaggggaagaaagaatctcaagaagaaagtaatttagttggtactgacaccaacaagaaacaaatattccatatatttggaggttgtaatgacctgcctggaggagctaaaatgttgttaaggactggtgacttcaccaacaggtcagacaaggaattctagtcctaatctcttacccttcatctcctgtgtcacggagttcagataggtgttgactgtggctctcaacttttcttgttcagaattatatgtaccatacattaggacaaggggtgttaaaaaacaaaaaagaattatatgtccttattcctctttgaactacatccctccctcatacaatattactcaacaaagttaataaaaagttattattattatttttttgagatggagtttcgctctcattgcccaggctgcagtgcaatggtgcaatctcggctcaccgcagcctccgcctcctgggtcaagcgattttcctgcctcagcttcccaagtagccgggattacaggcatgcgccaccacgcctgggtaatttcttttttttttttcttttttttttgagatggagtctcggtctgtcacccaggctggagtagagcggcaagatctcagctcactgcaaactccgcctcccgggttcaagcaattcttctgcctcagcttaccaagtagctgggatgacaggtatgcaccaccacgcccagctaatttttgtatttttagtagagacggggtttcaccatgttggccaggctggtcttgaacgcttgaccttgtgatccgcctgccttggcctcccaaagtgctgggattacaggcgtgagccaccgcgcccagcgaatttttatatttagtagagatgggttttcactatattgatcaggctggtctcaaactcctgacctcaagtgatccacccgcctcagcctcccaaagtgctgggaatacaggtgtgagccaccacgcctggttgaaaaataaaaagttattttttatcatttagttattagaattatttttaaaaacaacaatctaagccctctttagtaacaagacatttttggcacaaaattccaaaaaaattaaagtacatgcaaataaacttttaggatacaacccattttatccaagattgcccttttacagtaaaaaaaaaaaaaattcttctctctgggtgcaggcgcagtggctcacgcctattatcccagcactttgggagagcgaggagggcggatcgcttgagctcaggagtttgagaccagtctgggaaacacggtgaaatcctgtctctacaaaaaatatgaaaaattagtcaggtgtggtggttcatgcctgtgttcccagctactttggaggctgaggtgggggaattgcttgaggcctggaggtggaggctgcactgagccatgttgggaccactgaactccagcctgggtggcagagtgagaccctgatcttgaaaaaaaaaaaaattatctcgttggaatgtataccaactgacagtggtatttgccagtaagaatttcttgctcatttccctaaaggaatgagataatacaggactttagtgtatgcatcccttcatttcaaatatgaacaattctgaatctcttatcaaggccttataattctttacctacagagaagtagatgaaatgactaagtaaacattcagaggtttaatcaagtctggtttcaaaatcaggaatatgaatataaatatccaaatttctatttcataaaaacccattattatggaagaaaataattaaactgtttatgactacagcagaatgtacaggatatatagaattgtaattatcaccacgaacaggaaagacaagaatcttgatatttctattacactgagtaccttgtagctattttgttgaatgtcttttcatctctgataataaggtgtgaattaaaaagaactattccagagactaggaaatgatgatccggaatgatttggcaaggtaagacagtaagtgacagagtggaatcagaaactcgctttcctaattgccagcttagtacttcttattctaggctgtattatctgtgctgccgcaaggcaaaccatatcattgcctttcccattttagaaataggttgtataggagtttcctttgtggtctgatggcaagagacacctattatttaagaaatgccaactgctgatcattgatgacaaaatatttttacatgttccttatggattcaagttgtccgccatttcttcaaataatcatcacgtttctaagtttggtaagaaaatcagaaatgactgaatgttaaagagaaaggggccttaggcattatttttcctatcatctcagtggggaaactaaagcccaaagagtcatattgggagttggtgggagtctcctgacttcttgtccagggctatttatagcacatagcactgtttcagtggatgagtattctgaagccacggcataattgagactctgtacatggcaccttcactcatgttcaatgtgtcagtgtggggagtttgtgtgccattttatccctttatttttgtcatccattttattcaatactttcgttggtgcctgatgtttttgatagaaaaagcaaataaaagagtaagcagcaaatgtgagttaaaaaaattttttttttgagacagagtctcgctctgtcgcccaggctacagtgcagtggcgtgatctcggcacactgcaagctcctcctgccgggttcacgccattctcctgcctcagcctccccagcagctgggactacaggcgcccgccaccacacccggctaattttttgtatttttagtagagacggggtttcaccgtgttagccaggatggtctggatctcctgacctcgtgatccgcccgcctctgcctcccaaagtgctgggattacaggcatgagccaccgcgcccggtcgacaaaaattttcttaacatgaatgcgtgaagtaaggctgtttggaatttagaaaagttgcaatttttgatggagagaaaaccaagaaggagttgagtgatggccgagggagtggacaacctcctactgccagggcctctactcctgaactgttatgaggttgcctgattcctcttaacaacccttcaggttaggggccagctgttaacttaattttattaccagggaagaaactgaggctcagataaagttcttttatcccacaggcacacaaactgctaactgatagagccagatccagccatgtctggctacaaagcctgtgtactttaacttctacagagagtatgtgcgaggtgaaccagtaaaaataacaataacaagtgcaatactaagaatagtaataatgatagttaacacagtgctttacatgtgtgatcgctttgaacaggattaagtgaacacatgaataggactggcagggagtctttctactcttcattagcgaaacaggagaggacatatacagtacttaggatttccactggcttactttgttttctgaaaaataactgaaaggctcaattagttttgttttgtcgcatttatcagattataacgttctggatgtgggtctggatgtgggtagttgggctggtgtgggattacatgaaatcaaacctgatatattcagaaagattcttccggtggacacatatgccttttgggttcgatattcaattttgtaattagtgatcactgttcctatttatttatttatttatttgagacggagtttcgctcttattgcccaggctggaccacaatggcgcattatcggctcatcacaacctccacctcccgggttcaagcgattctcctgcctcagcctccccagtagctggggttacaggcatgtaccaccatgcccggctaattttgtattttttagtagagacagggtttatccatgttggtcaggctggtcttgaactcccgacctcaggtgatccgcccacctaggcctcccaaagtgctgggattacaggcgtgagccaccgcgcccggcctgaatgggagtttttaatccgtacttttttcttattgaagttgaatgtcatatacccctctatttccctagatgaatccatgaaagaagtatgttgccctctatatgaaaaagcaagcttgtcttctgcagaaaatcagtaaccactcctttttacacataaatacccccaaatgaatctccgatgactgatctgatactagtctgcaattctagttttagcattaggctcactcctcatatttgggagaagatgtccaattctgtagtaatgtgtaacataaagtggtgtcaatttataaataatatcttctaatgaattaatgctcatttgcaatgatcacttccatacaaatttaggtaaagatgttattcagaattggattctctctatttaaaaatgtcatcctaatgtgcaactccctaaaactgttactacaaacaactattttgccactcagcctaaaaataaaacctttcacccaaatgacacatcttaatagccatattttaatctacgtaattttaaactattctgaaagaatccatttctagatgtcagacaagagttgaaactgggacagcagtttgaaggggctaatttaaaaacccacttgcttggagacacctcaagaatttctaggctcacaaggtgggtgaagtaaggaaagagactaagagctgaacagtgccgttctttgcgagcccccactggcgcaggctgagccggctgcggctagggctgcgaagagttaacgagggaccgagccccagcgccgcgggctccccgcatgctccctccgccctcccgtccccaccctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgta

SEQ ID NO: 208 - DNA, 154306 bp, Homo sapiens
gccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggcagttgggagaagataaagcaggggagggagcttggtggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcccctgggtggaacaatatcgaagagaggaggatgttagccacttccattcccaagttggtgagaatttctataaaggacacctgcttcttggattgagggtgtgcagctgtcagagaagggaagaaactaccttaactaggctgattgacatccatgtaatatttactatgagacagggagagtgtttttattctcaattctttaaatttaaaataagacaggaaatgttagtgacataagggattgttagagaaaaaaagatgggaagatccgtaaagtgaatttgttaggggcaggagaagcctgacttggcattttcctgtttaggccaggagatattaccataatgcaaatgtgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacattttaagtgtcttttgaaatctgcttttgctaaatatttaaaggtatatatgacttagcagtcctgaatcagttgtttactgtcttccactttaaatcaggaatgagaactgtagagaacatatcaaatttgtgcagagcacagattcactgggctgctttctggctcaactctgatggcgagactgaaaaataacggtttgagtttagtcttccccacctggagttctttccagaatacagttttggatctgaaaacagaatcgttgaaacaacgtagacttcagggtcagagagaactgtatttaaaggctaaactatagtttaccaggcacatgacattggccaagtcacttaaccgttttaagcctcagttttcccagaaagaggataacatcttagtaacttagatattgaagtagttgtgattatttaaagcaagtccattgagcaccttacagagagcatatattaggcatttagtaagtggtaggctattatttttattaggaacaagacactgatgtttacaatattttaactaatgagctttctgaggtgaaaaaatattcctgaatgatgggacggttgtatttttaatacaacctttaaataatttttaaaaataatttttcaaagagcagtttcattaaatgctttcttttgatcacagaactctgggacagtagggcaaaaaaatattatctgcattatacaccttaagacttggccaagatcacagcagtaggtactggcagaactgggcctacactctcattctcatttctgaaaagattgtttcctgcctgaaacaatcttttgtacatccactacatgcagaaattagcatatagtgaaatgcacctttttctttatgttgggaacagcaaaactggtgtgaattatgcattctcatgtagattataatgattaggatccaaaacagggtagctatcttaatctaatttataatttttgtaaggatttggccagtttaaaagaaaaaacaattattcgtacattttgctaaaagcttctcatttctccttagtgactatttacttccatattgcttgctctgagtaagacccctgagagaaacaactgattcttcctacaaggtcttaaagttgaataaccacaatagttccctagggaaattaagtccccaggagccaaaggaagggcctatcattggcagctgtgcaatctgtgatgggaaatgtcacaccagggactcacgttcatgttttcacccaaatcactgaaaaaacagtttctacctttgaagcattagccatctgcaacaaacttcacaattaacttcaaggttgaaatcttcaatatgatttccctttaatgctcagaactccattagatgatgtgttctagtctgaggtaggctttgattgtctggtcattgaaaaagaggataaaggcaaatccaatggtatctacttccttcacttcaactgttccctgtactacttactcagtttggtatttctgcaatccagcttttctggagtgtgaagagattgcttattgggcatcccctcttggatgtatacaggtacttgagattttggaactctttctatatcctgttttagagaatgtcctcctagactgaaacctgggagtcctttatgaattcttcaactctcacagccaaatagtgatcaaggcctgtgtattacatttaatattgccttaatattttttgcttcgatcccaccaccatttgctatataattcaggtctcttcattttttgcctggattactggtttccttaacacaagtcttgctgaaattaatctctccagcatttggctgaagccttgccaatggtatctccatagtgatgacttctgaaataaaagctgattttgtcattccacatagcctttgggggaacctcctgacttctgtagataattacaaaggtttatcaagtggcaggcactggtatgtattatgttaattagtttaatccttataacgtgaagtaggcactattatctccaatttacagatgaggaaactgaggcacagagaaattaagtaatttgctcaaggtcagtaggggtagatctgggattcaatcccagcctgtctgggattgagacccgtaggctgtactgcctctcagaatataaaaatagttcacacatggccgggtgcagtggctcacgcctgtaatcccagcactttgggaggtggaggtgggcagatcacgaggtcagtagttcgagaccagcctgaccaatatagtgaaaccctgtatctactaaaactacaaaaaattagccaggcgtggtggcacacgcctgtaatcctagctactcaggaggctgaggcaagagaactgcttgaacctgggaagtggaggttgcagtgagctgagattgtgccactgccctccagcctgggtgacagagtgagactcggtctcaaaaaaaaaaaaagttcacacaaagtagttagcatatttaggactacacgtgtaaacttcagttaaatgaattggtaaatttattggtaaagccaataaacttggttaaaacatgttaatgcactggttaaaagactttgagtataacctaatagataatgagcaggatagtctgcttacagtcaattagttccagccttattctagggagaatggaattaattgtcacatgcatatttatgtaacacacatacatacaaacatatttacagatcaaatatatgtatatgtaatcaaagaaaacaacactgctatcaaagaataaaaagaataactgaactctacatcctaactgcttggaaagttagttacagaaatacttaaaatcacatagtttcttgatgttgagaactaatatcttaacactaaattaaagctacgtaaaacctccaagtcggcatttttgtgatatgaagtataataaatccagttatttttacaaatgaataagcaatgcagaattaagtagcaaagataaaaataatgtgtattgtcattcctaatgtatcgccaatgtgtcctgatattctcactactacttggcttatatatggccgagttttacaaattacatttataattatgggttaatgtgattattttactcactaatctggggtgattgatagttctaacttcaggattatgaccagtgtaaaacaatttctttatgaagcaaatctttttctttggtgtttcccttcccatgcaacagtttcaaagagagcttttctcctttttcccaccaactttggctctaattcagttccatccttggagcttctcttttttatatcaaaagcttgtgatggtatctttgcctcaactagtctcaagtactctaagtaaatacctttcaaactccatactttaaaatatcacactctgaaaggaaattatgcattatatcactttacaataactaaacacaatttaacatttttttggtcgattaaaattggtgaaattgtcatcactcattgaagaaatctggaaactttcaaaagaggtattaagctaattattataacttcctttgcttagatctatttttttctactactttacttacatttagcttgtggccaatttcttttctaggtctggaaaatttaccaaatcccactagatacgaagatactttgttctagcaagtttttagggctatatacataatctgaaaaccaaaagagcttttcgggtagtgccagtcagaaagggaattaaaacaaaaagaggctcactcgggaggggggagggatagcatcaggagatataactaatgtaaatgacgagttaatgggtgcagcacaccaacacggcacatgtatacatatgtgacaaacctgcacattgtgcacatgtaccctagaacttaaagtattaaaaaaaaaaaagctcacagctcagacttgttttaaggttgatgaatgaaaaagtggaagtagaattttttgaaacctatttggcatctatatgttcaatcaagaacgctgatccttgaactgcaaggacagagtggacactggtaagatgatgagggtcacttgaagtctagaatgtgtgaagcatttacatgagagcatctagatgtttacagtgagttcaagcctcctgacccagatgaattacatcccatgacacttggagaacctataaaggttacttttgaatcactgtcagcaaatgggagaggtgtcaaaattataaattcctcaaactctaaagatacaatgttgcacaatagtacaattctggtgttgaccagatctggtccagctgtgccacctgccagctatgtgaccccgagcaaatgatttaacttttactatacctcatatctttggaaaggaaataacacctacctagaagggctgtcgaactatatgaggtaataaatgcaaaatgttagcatgatgcacagcacatgacagatgctccacaaacagacattattaatacacataagcatgttaccataatccagagaaactctccactggattgttttagttatttgaagaaatatgcttataacttctcttattctcttttatcccatagagtagtttaaatgaaaggagatctagtctcacttttaatcttcctagatgtaaatattaaagatttccttatattttatattatgctctgataactttttcattcactgaaaaaaggactgtgctgccatagaatgaaaacattgaacgaaaacttccataatgccttatcaaaggaattaaagagttttaacaaacataaaaggaacatgctgtgattactaggatgccacatggatttactaagaaggctaacttacttttcattttggacaggattactagattacatctggaaaatatgactagtatggcataaatgaatttttgcttggcagaaggctggatttttcttgatgttgttatgctagtgtacaagtagcagtatgggccagattaaaaacgggttgaattaccacatctgacatgtgctgatcagttttatccattaagggagttggtgcttggtatgctctaagactgtctatatttcaatctgtctggtcctcttctttttttcaatggttcgaatgaaaatatgggtagcatgtttatctgatgtgtggctagcattcattgtaaatcaaaaattgcctgtggtgcaataaatatggcagtaaataaagacagacatggcccctatcatacctttagagctatcaaatgaggtaacagaattaggagctaaaatgacctcagcaggttataataatgtaattaaatttaatagggataaataactagtcctgcatttgggcaaagatctggcttagaaacaaaacctttgaaaaagacttaggattttagttgataacacgctcaatatctgtccaacagtgtgattcaactttccctccaaaaaagctaacataattttaagctgcattaatggaagtgtaaactatagaatagtaattcacattttttcctcatcctaaaccctgaaaaatattatatatgtacatttcaatgaatcactaactacagtgaccctcgaagcatgatttcctaagaaagtatgtttcgcaatcttcttggggtggggaaaagagaaagggtacatagtttgaagccgtatctattctctggagatctaataagttgtctgcttacacataggcaagtatcacacatggggggcacctatgagaacgtggggcacatgtgagtgttttgtggtgaattcttgagctagagggtaccagtgttgtaaaaaatttcttttcagatgcctttctgtcctatgacttttattatctaagcatatttttcttcgttatataaatattattaacattgtccccaaagccatatatttttctaaggtttaagggatggtaagggacaggtttttatctgtaacttcagggtactgcaatctctctgtctacatgttgtttatgtgtatgtatgtatgttttaggtaaactagacaaacttaattatttttgataaaaatttttgcaaaaaagctcattacaaatttattttgaaaaaaatgataaaagacattatggttaaagaacagcatttatagtaaaatgtttaaagtgttttttcactctttcttgatttgagagttggtttggcaagactgtgtaactatgaaatatttaatatttgcagacttaatgagtgactgaattgttgctaatgttttccaatgtttggggtggttataattctcacaccagagaagaaattagaagattgttgcctgccctagtttgcatatttgtatacaaagggaagaagaggtaatcatatctcctttcttcttcagggagaaacaataaagaaacatgaataaataaaatgaactagctgtgttgtcctcaattgcagatctatatcatttcttacctctctttcctactcatttctcctgtatagtaaaatacagttcacagaatgatactatttgtatcatttataagtgaagactgacctgtatgagaagtgttaaaaactccactacatttttacattggaaattattaacaaacttttctgaaaagaaaaaaaccatcaagtttagttctgttgctaaacatagcttaagcctgttcaaattcaacagaggtcagaaaggcatattatctgcatattagcagcctattcttctcttggagaatatctaagtacgcaaggagatccaagagaagatgggttatcaggatgtgaagagtagttacctgtggccaaagtttggagaaagtatctatgttcagagattttaccttgaaaaaatgtgtctggaaagttagatttttttgaaaaagtataataatataatacttatattccatttgctagagtgttagtttctgaagtgctttcttctacagtctcatacttttgtcagacataaaattctaacatccctaaaatttttaaaaaacaaattctatgttctataaatatgaatatgaacataactcttactacatggaaattagtctgtgaatgacctgggaaggaatttaaagaatcaaatgaaaaattctttaagaaatgaaaataagctatgtgcctcccatctgattaccatttaactgccatataggtatgatttggtctcatcatcgcatttgatactatcaaccatgtgccttccttgagtgttttatcatgttggagtctctttgttatgaccctctcatttctcctatttagtctcctttaatgacatctttgtgagttcattcaacaaataaagacattccttaaggtcctgttcttaaaaactcagtttttgaaaaaggagttattgaataccctccaagtgccagggactatattgggtgctagggataaaatgaatgacagtacatgtggtcttagagagcttgtactctgttggggggaagatgacattaaagaaaatattccaaaaagaaagagttaactacaaattttgacaagtgctatgaagggaaactacggtgcactattaagagcaatataagaaggggatcttactgaggctagggaaggcctctgaggaactgatatttgagtagagatctgaaaagtgtatagataaaaaagtccatgcagatgccagacacggtggctcaggcctgtaatcccagcacttcgggaggccgaggcgggcagatcacctgaggtcagaagttcgagaccagcctcaccaagatggtgaaaccccatctctattaaaaatagaaaaattagtgggtgtggtggcgggtgcctgtaatcccagctacttgggaggctgaggcaggagaatcgcttgaacctgggaggcagaggttgcagtgagccgagatcatgcctctgtactccagcctggtgatggagtgagactctctcaacaacaacaacaacaaaaaaaaaaaaaaaaaaaaagtacatgcagagagaccctgtattgggagggaggattatatattgacagaagtaaaagaaggccatccaagtcagagcataagaaatggaggggaagaatagtgtgggaggaagctgaagagattgctattcacatcatggaaggccccaagggaagctcttccacttccacagcttcaattctcagctccacgcagaagactcctatcacacacccgggcctgtcgaggggtgaaagggtaggggagggacagcattaggagaaatacctaacgtagataacgggttgatgggtgcagcaaaccactatggcacaggtatacctatgtaacaaacctgcatgttctgcacatttaccctagaacttaaaatatgataataataataaaaaaagattcctatgactatcttaactgttagcaccattactaaatttctgactgatggctgaatatctacacgtgaatgttttcatgtcaccttcaactcaaactcattatcttttatctggacaactgcagcagtctcctaattggttatccagatgcaaacctctctgctttaatcaacagaaaccagggtgcgctaagttcaaaccagagaataggaacatgtatctatgaagatcaataggacttcaatagttcaatgccatgcagtcttagcacctaagatctccatttgattagtattgctttaagtaacatgtaaaagacaccttccaaattcttaaatatcaagttccataaatactgaaaaccgtaagttaaaaatgaagcactacaatcatacattaaaatacatgacagcatcattttagaaagtgcacaatttattacatttatgagttcataataaaatggatacttaggaactttaaaaatgagttagaagtaacaattagatgtaaaattctcaaatcttggaaactgaaatattaaattctagaattttcttaaaaactctttcttatgaaagagaaatttgcatagtttgaaaattattatgtcctttcaagggaaaaaggaggaattaaaaaacagacacattgatgaaggcaatgagttcttctcagctggtttattctccactgaagctcaatataggattatattttctttacttacaggaagtggtcactgctctgttttccaataaccctcaaaacagaacaacaatgcttacgcgaaataacacaagccttaactattatactttgcaggctttaccatttcaatacacttctagtccaactgctttcccaactctaaagttctgtgagtgaactatgaatatttttaaatattttccagattcatcagggaggctgcttttcttctctgcactgtaatcacactgagctgcaattaaaataaacaatcggtaagtagttactttttctgtggaaaatcttagattaatacaaagaagaatgcatcacaacctataagtactgaaatggtcttattggaaagggttttgtaaatgatctttttctttttgaggcaatcttgctctgttgcccaggctggagtacagtggtacaatcacagctcaatgtagccttgacctcccaggatcaagtgatccttctacttcagcctcttcagtagccactacacctggttaattttaatttttaatttttttcagagacagggtctcactacgttgcccagaccagccttgaactcttgggctcaagcaatccacccaccttggtctcaaagtactgggattataggtgtaagccactgtgcccagtcagtgatcattttaaaattaatttctattttactcttgaaactttaaaatgtctattaatttagagaaatgcaggtcaaataagacattctatagctcagggtgatacgcttagaattgtaaaacatattccagatggatgaaaaacatctacataaaagttaatcaggaaagtttctaaaacacaaactaatgtaagccaacacaatgcaaggctgataataaagtgatgatagattataacaagtctaatagaaaaataatctttaaatgttagtaggaattaataacatatacacatagtaaaaaaagatctaacagtacaaaacggtagacagcataaaggaagtctcgttcccattgctgtctttcattccatagacccctctccagatacaaccactatttccagttttaaagtatgtttccgtaaatattttaaatgagaatatatgtatttcttcattcctttaatttaaaaaatgatgaaagtattataaacacttttcatcttgtgtttttcttctaaataatctaccttagaaatagctctatattaggcctactatactttattcctcttaatagctgcaaactgttcctctgtgtgaatactccatataaccagtctgctattgttgggtatttgtatggtttttaatcttttaaaaggagagacaatgcttcaatcagtatttttatatgtttgcttcctggcaaaaatgtttccaggtgcaagtgtgggtcaaaggttatatacatttacagtttttgaaagatactgccaaactgtgctccggagactgtaccaacatgtgcttatatcaataatatgtgaaagtgccagcacaatgcatttccaaacttcatgatctgataggtaaaaaatgatgtgattacagtttaaatttgtatttgtcttataggtgaggatgaacatctttttaaatgtttaaaagccatctgtccttctttctccataaacttcctttatatatttgtctaccggactgtggcattttttgaaaacttaggtatcctttatatgtgtttagggcattagccttttgtcatatatggtacaaatatttttctcggtttgtcactgactttatgactttttctgatacagaaatttgaaactgtgattatatttattaatttttttcttagcttctaggttttgtgttcttgcattgaaaggcttcaccacgctgatttaaaaaactcatatgttaacagaacacagtatggcattcaactatttagagtgatacacttagaatggatgaataacgtgtagagaaagttaatcagaaaagcacatttagagcacagtgcatcagcacgattcagggcttgtattgaaccagtaacacgatgctgcactgcactatggtaagtgtgatgtgtcagagatgataataatttttaaattttcttcattttgttaatatgcatttagtaggatattatttctaatagcactttttcagtttttataggaaaattagaagattcagagagggtaaagataaaaattaaaaaaataaaatgtacgtcttacaaacaaagttgatcacttggactcatttaaaacagaaaaaatattaactccagggaagaaattcctttttgggtaagggaaaagtgctgaataattaccttccatcttcaaataagaacagaatggaaggagaaaagcttagggaaagatttgttacagaacaattcgtgaagtggttactgacaaaacattttaaaaaggttagtcaaaagaacggtggaatctttgccattggagagtttaaacaacagaagaaacatcagtactagactgtttaggtttaattttttcaggggagaaactaaactagatgctaactggttatataattaatgtcctgtaatcgttccctttttactatagaactcaaggtagttgattttcgtagacgttttctttgccatttgccttaaaaaaggtaaacgtgaagctttaaggattatgatacagaaatttaatttcttacatatctgtctaaatatctacttaccactataggaaatgctttacatgtgttaattcttttgatcctttaataaccgtatgagggaggtattattatcctatattaaacatgaggaaactgaggcttagagaagttgaaattgcccaaagtcacaagcttttacttaatggcactaaatggcactaagcgatttgcctgacaccaaaacacatacttgccagatactgtccagtgcacctaacttctgttaccttataacctaaatacattcttgcataattagctaacccattagttaattcataacttcataagacataaaaattatttgaaaaggctgtaattactttcaagagggagagtaacagaaggataaattattattaaattttctttaagtggcatgccatgttcataacagaagtagattcaaaaaaatctgtaaatatcatgaacataaactgaattcagcaagcagagtggctttactatgtataaaatgctgtaatagttaagaataatattaattttgattgaaataatacatttataagcaaatataattaataatatagtaatttgatttgtttttgttttctcgcctcccctatctatctatccatttcaactgtctgtgtctagtctataatcactgaactggtctcattttgttcctcatatgagggactattgctcctactttacaatcaagggcctacttcatttatatgatgtgtgtgtattaagagaaattatcccttagtatttcattgttattctgcattttctactctatttcccactggacaacttttatattgtattttagatttttttggtcatatgaaaatatgcattaagtaaattaacttgtaagccaaggaatttttttccactgataagtaaaataaaaacaaagttagtgaaatttgaaatattacattcaaagcaatattatctactttcaaatctgttagtgaatctctgcctggttttagataggacataattctagagcagtgttgtgtaacagaactttttgttatgacagaaatgttccacatctatgctgtccaatgtgatagccctagctacatacagctattgagcacttgaaatctgactagtatgatggatgatttcaattttaaatttaatttaatttaaattaatttaaatataaatagtggcctgtggctagaggctatgattgttagacagtatatgtcttttctgttttttttttttttgttgatacagagtgagggtctcactctgtccgccaggctggagtgcagtagcacaaacgtggctcactgcagcttcgacttcttgggcccacgccatcctcctgcctcagccttcccagtagttggaaacagagatatgcgccactatatttggctaatttttaaaattttttgtagagaaaaggtattgccatgttttgcaggatggtcttgaactcctggcctcaagtgatcctcctgcctaggcctcccaaattgctggcattacagttgcgagccaccacgcatagcttatttttgtttccaatgtttactttttcaacctcacatattaaagggattaattttaaaatatgttaatctagtaaaaataaactattaagttccctgggaacttctaaaaaacttatctttgaactgtttattatctagggataagaggatgctccctacctgctgggaagctgaagcagctctctcttctgcctgacttagacgcctttgaagtctgttggctttttcttgatgctctagaattagcttttcattctattaaggggaaatagaaaacaagttagaaatccatatgtgacatggagatgttttgtggaataatcaacgaaaaatctggacatcactttaccacttataaaatacaaagaatattatctccaaatttacatttttcaagttatgagctttaaaatacaaactttgttttacattcttaataaattgttttctttctcccacatgccagcaaagaaagtgaattaacaaatctcaaagcaaaatgactcggaagaataagactttcaatttgtgaaggtcactgcttcagaatcacctggactgtgaaaacacagactgctgggccttacaaccagagctttagtaggggtgggatgaactgtttctgtatgttccccaagacatctgcatactccagagtctattagggtcaaaagagctattaggcactgttaggggttgaattgtgtcctaacccccagtatctgggaatgtgaccttatttggaaagagagtccttgctgatgatcaagttgagatgagatcattagggtggaccataatccatatgactggtgtcttcataaaaggggaaatttggacacagagacacacatgtacaaaggaaagacaagttgaagacacagagagaacacaatctacaagccaaagaatgtctgaggctaccagaagctgggagaaaggcatggaacagattctccctcacagctctcagaaggaactaacaatgtcaatacctcaattttggacttctagcctctggaactaagagacaattattttgcgttgtttaagccacccagtttctaatactttgttatggcaagaactatacaggcatcatgaatacaaagctgtcacaacatactgtcagacagacaagtgcaaataatctatcaattaaaaaatggaaattaaaaaatggattagctctctccacacttactagcctggttatagtacatctgaaaaaaatatttttgtacaactagaattgttaaacagtttttctggcacttatctgaatgagataataatacaagcctaatcaggaagagttagaaaaacacattttctatgaagaaccagaaacttatagttcccatgtcctaacatacaagtgataagaatgaatgttatggctattacagtaatataaaatattgaaataacagtatcctgctaaaatgagcttattatatttcttattatgcccaaaagcaaaattaaatgttatgaagagaactatattggctggtccaatttaccaagatgtttaaatatgtagcctctaaattttaagaagcacatcatatgctagagaaaacgggggaaaaaattccatcatctgtaataatcattttcatatttatacgcagacttcatataatgcaacttcttctatactgctaccataatggttgaggaacagttcagattggataaatcctagtatatgcaactgttccttttctattcatcattttggttgcttttgatcttcctatattattaacattactgtactgagtaccttctttcaaattttttttgtattttaaattactcattagaatagatatctggaaatgggagctacctgaaagattatttcaatggctattcctcaattaacttctaaatggctcatatcaattcataatgccatgatgcttaggagtaacgatttcactatagctactacagtagaccacaaagatggagtagaccatatattcagagaaattccaacaaacatttgaagttagaacatcaaatgaagagatctaaaaagcctcaatcataatccaaaaattgtttactttttgaatgcctcaaggaaaaaaacttgaactcttgctatatttagttctaaggcataaatctaaatatattttaatatattccagtaggcaaaagtattttttatgtgatgtgtcttttgggatggattaaaatgaaaaaagatgaatgggttaaaaaataattttagagatgcataagaataaaggggatcctaatacgttctctgaaatactacacaagttctattggtaaaacagaaataagagctctaccttttattatttacatatgatgaatcactgatgttcaaagcttttattcacattatattgcgtgtgggcttttagggttatggatgatttctgtattgttatttccaagtagagaaataatttggatttggctcaggtaaaattctataacatgtgtatcatgctgcagcagaaagcacttcccaggggagtcattatctcacctcagctaccttttcatttgccatttccagctgagaaagcagctcttgggtatgaagtttctgtcgactcagctcactcctattaagagcaccaaaaaatccattaatataattgttccaaatagaaaacagaatctttattagcaagatacatgttcatgatttgaacaaaaatatcatcttgaggtggaaaataaagtcacttactaatagaccatatctcaaggacttgtttatttctttttaacaaaacacacatatactctagagattagttgcacaacaatgtgtatacatgtaacactattggattgtacacttaaaaatagttaaggtggtaagttttatgtgtattttatcataatttaaaaaattttatcacaattaaaatggtaaattttatgtatattttgccaaactaaaaaaagcaaaataaaaatacatattttaaaagtacaaaagtatcttcaacattattttgagatactattagacactaaaataaaagcatactcatattaaaaagatacagtatttattattacaaaatcttgtaagctactgtgcttcttagctataatatgctttttttttttttttttttgagatggagtctcattctgtagcccaaactgaagtgcagtggcatgatcttggctcactgcaacctctgcctcccagggtcaagtgattctcatgcctcaacctcccgagtagctgggactacaggcttgcaccaccacgcctggataattttttgtattttagtagagacggggtttcaccatgttgccaaggttggtcttgaactcctcagctcaagcaatccaccctcctcggcctcccaaagtgctgggattataggcatgagccactgtgcctggccttagtatgcatttgtaagattcatatacagtgctttttaggggagctcaactcttagaaatttaaggaaacattaattactccagtatcacttcagtgcagtatagttagaattcttatttatgttttggttgtaaatgtactgtgttttactcattcatatcatttatgcttcattagctgaaattatcttacgcacagaactgtcttcttcttcttgttcaacgtataagtattctattgcttttagccaaatgtcacttcaagagtttcaggttaagggtacatacaatgtagccttaaaagtaatctgaacaaatatcagataaatttgtgagtattacatataaggaatcaatgacattcaaagcttttcttcacatcacactgtgtgtgaacttttagggttatgatgattatggatgatttctgtatcattatttccaagtagagaattaatttggatttggcttaggtgaaatccttgattcagtattggcttttatcctttgaccttacttgtgcttcttaaatcaatcaacagattagcacttccaaaataacttcagctttgatttttttcaaatgagccagcaaacagcctaaaaacttggtaagcctctcaagtatcctatagttgagtgaatagttgctaaaaataacaagtaatttgttataaatatataaaacagaaagcaatgtcatccactattcaattatacaaatagttactgaacattcgttacaggccaggtgcaaggtatgtggtggcaaacataattgttgtcatcacagaactgacagactacgagggagatcagttattctaacttagtgatttcataaacacaggttcattgactatgaggagtttgggtatctatcattaattccatgacagacaaaccaaaatatattgttttagctttgagtgataatgacaaaatagaataaattattatgcttactttaatgtatcttgtgcagcttaaaattactgcccaaccatccccccgacaacataagaaaaaaaacaactaaagaatgataaacaaaatgactagtggtcagtcttctaggtcaaatgtaattacaggtaaaagttacgcatattagtgctgatgaaaaataaattgtgagtataattgagattaagaagaaacgatgaacacatttataaagttagccaacattcagtttacacaaaaccttttcaggaaaacacctactggtataatttcatgcctaaactattattcacttacttactcaagacaatcttaatgatggatagtaatgattttccacaatatttaagatcacaaagacacaaatcattaaatgaaaatatactttgttacccttaatctatgtaaatatttatctctttatatatcaagctctgtctcccccattggatagtgagcaacttcattattcatctttgtactcaacaaagcttggcaaataatagtgaaaatgatgtgatgatgataataagagcaaacatttccatagtatttgcttacaatgtgccaggcactgttctaggtgctttcataaattaatttaatatttagtttgcatgactaatatataaaatctccatttttttttgagatggagtcttgctctgtcccccaggctggagtgcagtggtgccatctcggctcactgcaagctctgcctcccaggctcatgccattctcctgcctcagcctcccaagtagctgggactacaggcgcccgccaccacgcccagctaatttttgtatttttagtagagatgaggtttcaccatattagccaggatggtctcaatctcctgacctcgtgagccgccctcctcggcctcccaaagtgttgggattacaggcgtgagccactgtgcccagccccgaaatcccaatttttacatatgagaaaattaaaaaacagaaattaaaaaaataagtaacttgcctagggtcacatagcctgtcaggttttttgtttgtttgtttgtttgttttttgagagagggtctcactctgtcacccaggccagagtgcagtggcacaatcacggctcactgcagcctgcacctcccaggctcaggtggtcctcttgcctcagcctcctgagtagctgagccttcaggtgcatgccatcatgcccggctagtttttttgtattttttgtagagatagggttttaccatattgcccaggttgatctagaactcctgggctcaagcagtcctcccaccttggcctcctgaagtgttgggattacaggtgtgagccactgcatctggctgcttgtcagttgtacagtcaaggttaaaaaaacttggtcctttgattccaaagtccgtgctcttaaccactgccctatactgcaacatggcaggcaaataatgaaagttcattgagtaagtaacacacacacacacacacacacacacacacacacacacacacacacacacagagtatatgtgtgtgtgtatgtgtattaggccttctaggaatatgaaaatttatatacttacttggaaagctagcaattaaatttttacttcagacttcttccctaaaagtccagtcttaaattcaaacttaacaagcctaatatcaagctttttgcattgtcccacaaatctacttctcatcctgctcctcagtttatactgacatctcagccctaggtgtctaggttaaaaagcttaaagtcaactcctatttctcactttgtctttcttttttttttgtgagatggagtctcactgtgtctccccggcttgagtgcagtggcgtgatctcggctcactgcaacctccgcctcccgcttcaagtgattctcctgccccagcctccccagtagctgggattacaggcacccaccaccatgcccaactaatttttgtatttttagtagagatggggtatcaccatgttggccaggctggtatcaaactcctgacctcaggtgatccaccctccttggcctcctaaagtgctgggattacaggcatgagccaccgtgcccagcttctcactgtcttaaatgcaacatctcatttaccctgaaagagactctctctttgatacgtctcttgcatctatttttcattcctattcagtgttaccatcccaattcaagtccttagaacttaattcttagagttattgtaataacgagctgcttgggtttctcaatatcaggtgaaacaatatatgtaaagcactctaccacagggcaaatgaatgtactcaactaatatagtgggtttccctctctaaaccatgtatctctagcatatttctctttccaaaacaccactttaataatttgcttctttgagtgataatcttcaatggctctcagctattggacaaaatagtccaaattcctgagaatgtcataagatcctccaaaattttgtgtaatttatctttccaaccttatccccaaaaggaaccttccacacttcagttgggctctcactgtctcgaaaacaaactgcatatgtattacctcaggatcaggtttatattattttttagattgtgtttttcggatttcccattacaattctgcccattctttaagactgcacccttggtggggtgaagccaagatggctgaataggaacagctccagtctacagctcccagcatgagcaacgcagaagatgggtgatttctgcatttccaactgaggtaccgggttcatctcactggggagtgtcagaaagcgggtgcaggacagtgggtgcagcgcacctagcatgagccgaagcagggcgaggcattgcctcacctgggaagtgcaaggggtcagggaattccctttcctagtcaaagaaaggggtgacagacggcacctggaaaatcgggtcactcccacccttaatactgcgcttttccaacagtcttagcaaacggcacaccaggagattatatcctctgcctggcttgaagggtcctatgcccacggagcctcgctcattgctagcacagcagtctgagatcaaactgcaaggcggcagcgaggctgggggaggggcacccgccattgccaaagcttgagtaggtaaacaaagtggccaggaagctcaaactgggtggagcccactgcagctcaaggaggcctgcctgcctctgtaggctccacctctgggggcagggcattgccaaacaaaaggcagcagaatcctttgcagacttaaatgtccctgtctgacagctttgaagagagtagtggttctcccagcacgcagctggagatctgagaacagacagactgcctcctcaagtgggtccctgacccccaagtagcctaactgggaggtaccccccagtaccgggtactggctgggtgctcctctgagacaaaatttccagaggaacgaacaggcagcaacatttgctgttcaccaacatccactgttctgcagcctctgctgctgatacccaggcaaacagggtctggagtggacctccagcaaactccaacagacctgcagctgagggtcctgactgtcagaaggaaaactaacaaacagaaaggacatccacaccaaaaccccatctgcacgttatcatcatcaaagagcaaaagtagataaaaccacaaagatggggaaaaaacagagcagaaaaactggaaactctaaaaatcagagtgcctcttctcctccaaaggaacgcagctcctcaccagcaatggaacaaagctggacggagaatgactttgacgagttgagagaagaaggcttcagacgatcaaactactcccagctaaagtaggaagtttgaacccatggcaaagaagttaaaaaccctgaaaaaaaattagacaaatggctaactagaataacgaatgcagagaagtccttaaaggacctgatggagctgaaagccaaggctcgagaactacctgacgaatgcacaagcctcagtagccgattcgatcaactggaagaaagggtatcagtgatggaagatcaaatgaatgaaatgaagtgagaagagaagtttagagaaaaaagaataaaaagaaacgaacaaagcctccaagaaatatgggactatgtgaaaagaccaactctcgtctgattggtgtacctgaaagtgacggggagaatggaaccaagttggaaaacactctgcaggatattatccaggagaacttccccaatctagcaaggcaggccaacgttcatattcaggaaatacagagaatgccacaaagatactcctcaagaacagcaactccaagacacataattgtcagattcaccaaagttgaaatgaaggaaaaaatgttaagggcagccagagagaaagatcgggttacccacaaagggaagcccatcagactaacagctgatctctcggcagaaactctacaagccagaagagagtgggggccaatattcaatattcttaaagaaaagaattttcaacccagaatttcatatccagccaaactaagcttcataagtgaaggagaaataaaatcctttacagacaagcaaatgctgagagattttgtcaccaccaggcctgcctaaaagagctcctgaaggaagcactaaacatggaaaggaacaaccggtaccagccgctgcaaaaacatgccaaattgtaaagaccatcgaggctaggaaaaaactgcatcaactaacgagcaaaatcaccagctaacatcataatgacaggatcaaattcacacataacaatattaatcttaaatgtaaatgcgctaaatgctccaattaaaagacacaggctggcaaattggataaagagtcaagacacatcagtgtgctgtattcaggaaacccatctcacctgcagagacacacataggctcaaaataaagggatggaggaagatctaccaagcaaatggaaaacacaaaaaggcaggggttgcaatcctagtctctgataaaacagactttaaaacaacaaagatcaaaagagacaaagaaggccattacataatggtaaagggatcaactcaacaagaagagctaactatcttaaatatatatgcacccaatacaggagcacccagattcataaagcaagtccttagagacctacaaagagacttagactcccgcacaataataatgggagactttaacaccccactgtcaacattagacagatcaacgagacagaaagttaacaaggatatccaggaattgaactcagctccataccaagcagacctaatagacatctacacaactctccaccccaaatcaacagaatatacattcttctcagcaccacactgcacttattccaaaattgaccacatagttggaagtaaagcactcctcagcaaatgtaaaagagcagaaattataacaaactgtctctcagaccacagtgcaatcaaactagagctcacgattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatcgaaaattgacaccctaacatcacaattaaaagaactagagaagcaagagcaaacacattcaaaagctagcagatggcaagaaataactaagatcagagcagaagtgaaggaaatagagacacaaaaatcccttcaaaaaatcaatgaatccgggagctggttttttgaaaagatcaacaaaattgatagaccgctagcaagactaatgaagaagaaaacagagaagaatcaaatagacgcaataaaaaatgataaaggggatatcaccaccaatctcacagaaatacaaactaccatcagagaatactataaacacctctacgcaaataaactagaaaatctagaagaaatggataaattccttgacacatacaccctctgaagactaaaccaggaagaagctgattctctgaatagaccaataacaggctctgaaattgaggcaataattcatagtttaccaaccaaaaaaagtccaggaccagatggattcacagccgaattctaccagaggtacaaggaggagctggtaccattccttctgaaactatcccaatcaatagaaaaagagggagtgctccctaactcattttatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgccaggctggttcaacatatgcaaatcgataaacataatccagcatataaacagaaccaatgacaaaaaccataagattatctcaatagatgcagaaaaggcctttgacaaaattcaacaaccattcatgctaaaaactctcaataaattaggtattaatgggacgtatctcaaaataataagagctatctatgacaaacccacagccaatatcatactgaatgggcaaaaactggaagcattccctttgaaaactggcacaagacagggatgtcctctctcaccactcctattcaacatagtgttggaagttctggccagggcaatcaggcaggagaaggaaataaagggtattcaattaggaaaagaggaagtcaaattgtccctgtttgaagatgacatgattgtatatctagaaaaccccactgtctcagcccaaaatctccttaagctgataggcaacttcagcaaagtctcaggatacaaaatcaatgtgcaaaaatcacaagaattcttatacaccaataacagacaaacagagagccaaatcatgagtgaactcccattcacaattgcttcaaagagaataaaatacctaggaatccaacttataagggatgtgaaggacctcttcaaggagaactacaaaccagtgctcaaggaaataaaagaggatacaaacaaatggaagaacattccacacgcatgggtaggaagaatcgataccatgaaaatggccatactgcccaaggtaatttatagattcaatgccatccccatcaagctaccaatgactttcttcacagaattggaaaaaactacttgaaagttcatatggaaccaaaaaaagagcctgcatcgccaagtcaatcctaagccaaaagaacaaagctggaggcatcatgctacttgacttcaaactatactacaaggctacagtaaccaaaacagcatggtactggtaccaaaacagagatacagaccaatggaacagaacacagccctcagaaataatgccacatatctacaaccatctggtctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaactataaaaaccctagaagaaaacctaggcaataccattgaggacataggcatgggcaaggacttcatgtctaaaacaccaaatgcaatggcaacaaaagccaaaattgacaaatgggatctaattaaactaaagagcttctgcacagcaaaagaaactaccctcagagtgaacaggcaacctacagaacaggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcatcatcactggccatcagagaaatgcaaatcaaaaccacaatgagataccatctcacacccgttagaatggcaatcattaaaaagtcaggaaacaacaggtgctggagaggatgtggagaaataggtacacttttacaccattgggactgttaactagttcaaccattgtggaagtcagtgaggcaattcctcagggatctagaactggaaataccatttgacccagccatcccattactgggtatatacccaaaggattataaatcatgctgctataaagacacatgcacacatatgtttattgtggcactattcacaatagcaaagacctggagccaacccaaatgtgcaacaatgatagactggattaagaaaatgtggcacatatacaccatggaatactatggagccataaaaaaggatgagttcatgtcctttgtagggacatggatgaagctggaaaccatcattctcagcaaactatcgcaaggacaaaaaaccaaacaccgcatgttctcactcttgggtgggaattgaacaatgagaacacagggacacaggaaggggaacatcacacaccagggcctattgtggggtggtggggggggggagggatagcatttggagatatacctaatgttaaatgatgagttactgggtgcagcacaccaacatggcacatgtatacatatgtaactaacctgcacgttgtacacatgtaccctaaaacttaaagtataataaaaaaaaaattaaaaaaaaagactgcacccttgtcccccttcttttcaggtctcctttccattcattttaatccagacagctttctttacacatcaaatctctatgatattaaatacttattttatgtataagagatttatcaatcctgtattataatgctagtattttacatatatgtatagatatgcacatatatgtacacacacatacatacacacattcttctaagtggaataggaacttttttttgtttttgttttgagatgggggtcttgctctattgcccaggctggagtgcagtggtacaatcatggctcactgcagccttgaccttctaggctcaagtgatcctcccacctcagcctcccaagcagctggcttggctaatcttgcctggctaatcttgtgttttgtagagatgatgtctcattatgttgtccaggttggtctcaaactcctgggctcaagcaagcctcccacctcggcttcccaaagtgctgggattatagttgtgagccaccgtacccaggagaaacttttaaaagaaggattatttttagtttccacagtatctaccacgctgctttacaaatccaaatggagtcatgcatcagttaataataggaatacattctgagaaatttatcattaattttattgttgtatgaacaccacagagtttgctacacaaacctagatggtaacgtctactacacacctaggcaaaatattaatagtatagcctactgctcctaggctacaaacctgtacagcatgttactgtagtgaagactgtaaacaattttaacattgtaagttttcgtgtatctacacatagaaaaggtacagtaaaaatactgtataaaagataaaaaatggtacatctgtatagggtacttgccataaatggagcctgcaggactggaagttgctatgggtgagtcagtgagtgagtggagaatgaatgggaaggcctaggacattactttacacttctgtagactttacaaacactgtatactgaagctacactaaatttataaaaacatattttttcttcaacactaaccttagcctactgtaactttttactttataaaatttttaattttttaacttttgactctaaaacacaaatgtacagctgtacaaaaatattttttctctatatccttattctttgagttttttgttaaaaacaaagacaccaacatatacattagacaacgcctacacagggtcaggattatcaatatcagtgtcttccacctgtacatcttgtcccactggaaggtcttcaggagtaataacacacatggcactgtcacctcctttgatagcaacgcctccctctggaatatagctcttgaaggacttgcctaaggctgttttacagttaacttaaaaaaaaaaacatgtaggagtatgctctaagataacaataaaaagtacagtataggaaacacataaaccagtaacactgctgttgattttcaagtattatgtactatacataattgcatatgctatacttttataagactggcagtgcagtcgttttgtttagcatcaccataaacacctgagtaatgcattgcactaagacattataacagctatgacgtcactacgcaacaggaatttttcatctactttataatcttatcagaacactattatatatgtggtccatcgttgaccaaaatgttatgtggtacattaccatatttgctgatttatggctaaatttctaattttctaaaattagaaaagttctaattttctaaattatagaaaacatagtagttagaaaattttaatccttatttgctcaagatttactgaggaatttatcagaaaaaccatattttagataaaaactattggtatttatttagacttatttatattcttctttctccaaagaaattgaagtggctaagaaaagcttatttttcattcaagcatttctttcaaccttacagttttcttccaaatgaaattttagaaggtattaaagggtgaagagaaaagtgatttcacaaactctatcccctgagactttcctagagccttcctgtcagtactttgtatcttcttatttctctgtcaggatgtttcattgcagggataaaggaaagacccgggaggatgattcgactctttgttatctacaagacattttcccttcattagagaaaataattgagagttccctgtatcatgaatgatttaggataaacattaaataagactttccagaaagtttcacagtggtattacagttgaaacacatgcccagtaagactatataatctcttccctggaaatctttaagaacagaaacattcatacctatcagagatgatttaagtgtagcttgccggaagacacagagatagaggaaatttcattctggtatgatattttaaagagtattttgcaccaagtaattgaaataaaactgtacccaatttctctataatttctggcttattatagggtataaggatcaaggtgtaattactatcttccactaattttaaagtacatatagaagaatgaggaatcccttatagtatcactgggaagtgcttagttcatcagtgtctcatacgtttttagttcacttatataattcatgtttatgtgacagaaaatcttactcatccttacaaaacataatttagaaatatacttgcaaaatgtaatttctgtgtaagtaaaagtttactaagtaatttacatatgaagcaatttatgttgtatgtattaaaaaattaaatgcttaaataaacaaaatactgtaatcaacactgatatgccatcagattagaccattgttggaagatctttcagcccttccctctcttctcctgagtgcccactgtttgttgttcccatctttatgtccacgttgtaccagtcttttaatcaaaatgttttctcaactaaatcatattgtttcccacttaagtccaatcaattacgagagatgttagtaaagcaaatctgtaatatcatataatattaagatctaaaaggcaaaataaatattttctgaacaaaatatttaatcctagtatgtggcaaaatggttagcaaatgcaaagattgtaatctcaactttttgtatggcttcaaaagacctgactgctaaaaaagaaaattcattccaaagtttcaaatcttttctcattgttaactaaaaataccatgggttaaggcaggcgggtcagcgttagatatactggagaactttgggtcagtgttaggttctttctttccctatttacactttccccctaagtgatcttgtctagtccatgactgtaaatataacattacaaatttctatctttagcctgacctctctgtgctcttcacttgtgtattcaatgacctacttgacacgtttactagaaaaaaactaataagcatctcaaatgtaacctgtccaaaatggaaactacttcttatctatctcttcctaagttcccttcttcctagtaaataagcattgccatctacctggctgctcaagtcaaaagcttaggcatcatctttgattcctcctttttccttcatgccctatatttatcagtaagttctattctaccttccaaatgtatttcaaaactgcccacttctctccatctccactgaagataaccctattctaagccactatcatctattgccaaaactactgtaaaactctaatatctggtttctctgattccatttttgctccctctctagtctattttccatacagtagttataagtggtctttaaactctaaggatgtttcaaattctccagtgatttcccactgctgcactttagacttttttttaaccttaaaatagtactacttaaacattctacttaaaatgagtaaaagtatctcatttagaatagcccactcaatctgatccctgctgaggtagcttttcaatattacagcattctttcccctcactcactatactcactcacatgagcttactccttcctaacactggacctttacacttgctattcttccatctgcctggaatattttcctgactttttagtataatttcttctcatttttcagacctcagtttaaatgtcacctttttagactatttttttttttctaaaataatctagctcttctaactcctacctccattccagtaatgtatcacatgactccatttattttcttcataccactttaaacatcttaaattgtttatttgttggttctgattgttatattgttggttcttctcttacagcctctccccactagaatgaaaactcctaaggagaagctacattcacaaggcttagaatgtaactggcaatcaaaaggtgtttttttttagcctatgcatgctttaattaattccacagaatcagttgcctagtccatccagtaataacatttctaatatcttacatcttgccttttcaaagtttttgctaagtacttgctctcatatcagaactaatgagataattcagtgattatattttcttttttttgaaacagagtctcgctctgtcgcccaggctggagtgcagtggcgcgatctcggctcactgcaagctctgcctcccgggttcacgtcattctcctgcctcagcctcccaagtagctgggattacaggtgcccaccaccacacctggctaatttttttctatttttagtagagacggggtgtcatggtgttaaccaggatggtcttgatctcctgacctcgtgatccgcccgcttcggcctcccaaagtgctgggattacaggcgtgagtcactgcacccggccgattatattttcaaagtagccatcaagtgatataataaatttgggagattactaataggaaaatcaatgtgttctaaagctttatttataaagatccttcacaggaagcttattttaaagttatttgaagaatgaactgaaagttacaaagtaatggttgaaatttcctcacaacatctattgttaagtgctcatcttagaaggagtttggggaaattatgaagttcactcatttaataaatactgaaatgagtgcctgttacatgctacatactactgtgctaggtgctagggagacaaggaggaaacaagatctagtcactgccatagtgaaacttatgaaccactagaaatattggaaagctactaggcttaaaataggtagcaaatgctataaaaacttcatggtgctatgataaaacatatggaagaatcgggggttagagctgtctcttcagaggaagtagacttttaagctgatatataaaagataaatagcagttagatggaaaaaggcagaagaaggaaaagaagagtgtcacagtcaaatccgtgtgtgaagaccaggaaaaaaggataataaattcaggaaacaaaagaagttcagcatgaatgagatacagagtgttactaggaggtgggggtgggagtgagagaggaacaagctggaagtgcaaggaaatacagatcacaaagaaccttataagtcgtaacaggaaattggcactgaagtattttaagaagagaagtgacgattcgatttgaacatcaggaaatcttgctgactgtagcaggaaaaatagtaaggatattaatccatagtcaaattagagtgttattgcagtaatccaggtgagcaatgttgacagcctgaatgatagcaactggaaagaaatggacagattgaagagatatctaggagattgaattagtaacactggggtttgggttatgaggaggagtccaagatgatacccagagtttttcttgagcaactgggtagatgatattaccattcacagaaatgggaaatataggatgaaataaaaataaaaacttcagctaggggtgaaataatgggttcaatttagactaaactcagtttgaagtacatatgaaaatactcagtagagagttggaaatacagactatttcaaaaaggtctgcattagaagatgttttataataataattggcccatttctgtttttctctatcatagaaatgaatatcctaacccatattgaaagtcaagagtttccacactaattgtattttaattgtgactatcactggcatatccattagctgaaatggtatggttatgagagtatgagcaaggttttccctgcaatgtatccatctctttgaaaacatcacacatactttaaataaaacaaataaaagacatatgaaataaaacaaagttacttaattatgggataagaaatttaaatttaggctaacatcttggacactttaattaattactataattgcttggaccagtctgttatgattgaggcaccgtttaaggtaaggatgagccatgtagattttggctgatacagtacaaaggaaaattccttcaatgcatgaaatgctttagtgatgactgatgattaaattgcataaggttctattctatattatatgagagaattaaaaacaaaaggtgcgctattcatttcagtgaaatgatggatctgccagctgcagcaagcactttccttggaactctcttatgacaaattaacatagcatgtgccagatgtttttttctttttcctgttgaattatgctataatatgcttcagttacttttagtaattatgtattttgtaatttgctggtacctgcagctgcctctcatcctgttaattaaaaaaaaaaaaaagaaagaaaaaaacagttacagcagccaaacattacagatatacagccaaggaattatattgttttacaaagtgaagagaatgccttaggtgcaaatgctgtgtagttcactctatatgtacagtttgttttggacaagcgaatattacatactgtatattcatgtgttcattcatttattcaatacaatctaattgaataattagattcctttcccaattaaaactgtttaatctggttaataaaaccataaatatttagatccctgtctgcagcagagacaacagtgttcaccagacattccatgtgtaccatacatttcccagacttctatgcagttctcaccaatggaggtaaaagttagtgatatatataatttcaaaactgagttagttaagtgcccatgttcctcttccattcctctctttctcagaggtgatctcaggaaaccacgtgttaaagaaggcgtacactctagtagagccttcctgccaaactgcctaagacatgcaacgtaagcaataataaacctttgttttgtttagtccctaagatttcagtttgtttgctgtggtggctgacattgcttaacataataaactgcgtagatctgacctactcttacatcactattgcctcattttgcatactatttcttttacttcaaacatactgattgtattactgctttggcggtctttgaactagctgttctctttgcttaaaatgctctttctcctgatctttatatcctttttatcattatatctcaccttaagattcatttcttcacaggatctacctggtctaccaccctcagatatccaacaatccattatcacactggcttattttaaattttctttctttttttacagacaaggtctcgctctgtcactcaggctggagtgcagtagcatgatcatacctcactgcagtcttgacctcctggctcaagtggttctcccaccccagcctcccaagtagctagaactacaggcacacacaccatgcccagaaaactttcataatttctgtagggacagggtcttgctatgctgcagaggctggtatcaaactcctggcttcaagtgatcctcccacttcggtctcccaaatgctgggataacaggtgtgagccactgcacccagcctctaaactttttgcatggtacttattatctgataattaacatgcgtatgtttatttattcaataatttctacttcactgtcaataatctaaacttcaaaaaaataagaatcttgtctttgctgtattcccattacttcaagaacagtgcctgctcaataaatacgtgataagtgaataatatgtagactaggaatatgtccgagggctggccaagcacttttggtttattggggtggttgttcagtgtgactggagcataaagaacttgaaggctggaggcagagaggcagactgcagataaaatatggcagagaaaagactgtgaaaaatctgtaggcaacaataaaacagaagtctttaagtaggcagggccagtatacttactttttagtaaaataactgtaacagcagtatgaaagatggaatagagtggggaaaaatttgatggcagagaaaccagagtgaaggcggccactttaggagccatagttaaagatgtgagggccctgaccaactgcagggacacgtatgtcaccgcatgcttatacacatgcaagtatttctataggacagactcctgtaccaggaactgcaaaaggatctgtacagtttaaatttagttagattttgctacattaccttataaaaagtatttgccagtttacattcccacctatactgtatgacaactcctgtttccccatgtatttgtagatgctggatgttaaccatcttctacattttgccaatttgctgggtaaaaattattgcttaaatttgcatctctttaatgaaaagtgaggctgaacttgctttgctatgtttaaaggagatttgcatcgatacttttgtgagctttgtttgaaccactgagttcacatactttgtccatctttctattaggttgttaaccttttaatgtggaacttgatgaattttgcacattaacccttttaaaatttttccagtatcccatttgtcatttatctttgtttagtatctttcttcataaaaattttaatttttatggttagatcgattaatcactttttcttttttggattctgggttttgtgttttgattagaaagtcttctctattccaagagaataaaaataattttatttcttctaatacactcttttttacacttagctctttaatacgtctggaatttattttatatatgaaataaagaatattctaaatgattttctatctttttaacatcatcttttcaccaatgatttgaaataccaccattatcataaccaaaatttctgattttatatttttttttctttttctgcattctgttcaaattatctatccttgtgccaatactgttttatgtattttgatatctggtagggaaaatctcatttttttcccacagaggtttgttgatttcatctataaaaatagtaacaacaggccaggtgcggtggctcacgcctgtaatcccagcactttggaaggccaaggtgggtagatcacctgaggtcaggagttcgagaccagcctggcaaacatggtgaaactccatctctagtaaaaatacaaaaaaattagctgggtctggtggcaggagcctgtaatcccagctactcgggaggctaaggcaggagaatcgcttgaatctgggaggcggaggttgcagtgagccaaggttgtgccattgcactctagcctgggcaataagaatgaaactccgtctcaaaaaaatataataaataggtaaataaaataacaacaatctctcatttaagtaagattagtacatatatactgcagttacagatactatacactaataagttaactagtaaaacagcttcttctttgaagctcaaaattctttgtgatacatacattgcaagataaagtagtagtagctaagaggggataattatagaggaattaataagatattacaaattaaacttcaaaccaaaagataccatacagaaactcaaatttttaaaaagcttctgatcctaagttctccgatactaagatgaaaaattacctatgaaaaaattattttatttaattatttggtgttacatttagttttgaccatagttacttatgggtagataattttaaaaatcacaggtactggtaatcatatttaattgtcagttgcgaaaaggtatagaagtttccacggggaataaagcaagtcaagggaggactacgtatatcatgactatacttatatttggttttgcctctaatattctcctaactgtagcaaataggtggacaaaagcaagcaagaaaatagcaacttaaaagaattcaattcttatgaagtagagaggacagaggcaaacagccaagtactttcaagattcaatgcatacaactaatttagagaccaaggaatgctagcactttttaaaaggcatattttcagggggaaagctttgatgcttaatacatcacaataatgcacacagagaagcaggatgctgagccctaacctgaaaaggctcacttttgaaagcgagtaataacacttttgatatgaatgctagaatatataatgctgtggtatatatagagacatcattacacggagagtcaaatgcatcaaacaagccatttacttttaaaatgctctgtagtttattttgcaatttattattaattaaagacctaattggttcaagacttggactataccattgaatcactaaaaacaaaaacacttctaaggagaacaaatgaattcttccccagagatatggaagtaccatctagcagttagtctggtactttactgatgctcaatatggatgctattgtatgtcaagggtagattatcacctttgtaacgtattttttcattaaaattaaaaataaattttttaacttgaaaattataaatctattatgactgtcatagaattttgtattatgaccaataggtaagataggtcagtgaaaatacttcagtagatacattttattgatttcatgcataatcttcagtattatttatgttctccaaaaaggagggatacaattcatatatataaatcttgcctaaaatctactgccttctagaactagtaatctttttgtgcaagtaaaagtaagtacatgggcttttctctcctactcttcctcctcctccttcccctcctcctcttcccctcctcctcttcgccctcctcctcctttttctttgtatatatatataaatagagacagggtctcaatgtgttgtcctttaccaagacttggtttttaaggctgggcagaaaaggaggtaagctttgaaacagaaagaaaaaaagatggcaaaaatcctagtgatatttactggatttactggattcacatataccactggtcaagatataaactgcaatcttgactatttaggctaggcagggctttgttaccaaatgtgatttgctgagcatatctggccagtgctggcagaaagttcaaataaatttaaaagccaagatttcacttaagtaggaattttctttagaaggtttgttggtttgcttcaaattgcttattccatgaattatttctatttgtttctctcagggtagttaaccatttcatgttgctacgttcggcattctgttgttgtggaaaattgttttttaaaacaattctttgtatttaactgaacatctaacaaggaggcactacagcaaaacaaaaataaaatctagggacaaatgaagagtttgttcttacactggagcattacagccaagttgacaggaaacacaggcatgggaaaatataactgcagtgtgggaaactgcagaagttctcttctgattgcttctcttttctcagtgaaacaggaattgaagttattgcctaaaagggatgatgggggaggagttgcaaaaagatttgaggacagaataaagggtatgaaatagtcaccaaagagagtagaatatataaaatgattgtcttgcagcactaaaggtcccttttgtggtcatgaatttaaagtgagacaacccagaatggctgtgtgtgttttttccagccaccttgagctgaatgagtaaagctacagagaagacgagttatatttaaacagggctgtggttggccaaggaagaagagaaagaagggcaggagagtggaggatgattatctctgctgacctcttctaaaatggggcgctctcaaaaatacatacagtgcctattggctttttctgtttatttttctctttagcactcaccatctatcacatatttaatttctcttgtttaatttgagaccaattaatgtttgtctcccctattagaatgaaagctccatgagggcagggatttttgcctgttttgttcactggtattgtcttttaaaaggtatgagtctttgctggataacagcaaagcaggtatcagagtactggtactcacccgctcctcaccactgcccacaaagagaagtgactagctggcttactacttagcagctatttctaaagcactgggcgatttggatatcattttgatctttaaaactagtaatattgccgggcgcggtggctcacgcctgtaatcccagcactttgggaggccgaggcaggtggatcatgaggttaggagattgagaccatcctggctaacacggtgaaaccccgtctctactaaaaatacaaaaaaattagctgggcatggtggctggcgcctgtagtctcagctactctggaggctgaggcaagagaatggcatgaacccaggaggtggagattgtagtgaaccgagatagccactacactccagcctgggcgaaagagcgaaactccgtctcaaaaaaaaaaagaaactagtaatattatcttttattgtaataaaaaatccttaatgtgatagatgtttctctaaaatcttaaatagagtaataaaaaataggaagtgatgagaaatgagattggacatacatgtgaaaccagatctaaaagctgttgcagcagtccagggataaatgaagagtttgtaagagaggtcagagatgatggtgatctgatctaatataggagtagcggggatgaaggcaaatggatttgaaaacattaaggagaaagaagagaaataatcaaacatatctgaaagctgactatagaggtgcacaaaggggatacagaaagaggagcaatctatggaccacatttaggtcattctatggaccacatttaggttgttttcaagatcatggttattggaaactatagtttcttctacagtatttgaattttagttaaaatcaatgccaaaaagcccacacaaacaaataattttcagtattcaaatgaattaagctatgatggtgtgataacaagtagcaagattgatgaggttttttgacacaactcattctagtaaactcctttaagttagtcatatatgggctactctgcttgctcataaaggggcacggcatactagaattcaagttgaaaggattcttctttggtgttgcactgctggctagcacactcctttaaaaatcacatttcaataattcttaaataaattacctgtaaacatttaaagaatcattatcaagtgcccaacactatactatagactgttatgcttaaccaaatagttatgttcatatatagataccgattcaacatactctgccaataatttctagtggtctggtgcctgtggacatacatgcccagttcacagaggtctgtgttatacggccaacgtgtacttttctagatttcagaataggagttcaaaaaattgaataatcctagctgcaatgttttgtgcaatatttctcctctggaagtatgaccttaattattagcaatactgatttttaaaaactatttcacccaattaatcctagtgcttatgttcaggactatgtattcctttattatcaacagtcttcataataattcttagaatcaatagcattttcaagtttgtaagatgagaaacaagtttcattatacagcagtggtacaattatgggaattcaagtttcttaggtctgttaaatactgggggcacattatatcatgttttaaaagttcaaatgcatttcaaaaagctgaaattctactttgaccagaaaggatcaaaactggaagaagagtttggcctagaaaagaaacaataattgataaaattcactagctttcattcattcattcattcattcattcaacaaatatgttctggatatctactagtgctggacactcttttaagagctagggatacagtgaggaataaaacaaactttatggagctgatagtcccataggaaagacagactgttttaaaacatgtaatgaaacaagtataaaacataattactgacagtgatgaatgctaggagaaacaaagataggcaatgggacagaataagttcttagtggcaaagccttattcatcttgtgtttctagcatttagcagaatgcttggagaagaatggtcactcagttgtcatataaattaaactgagttttaagggatctgcttttgtttctggatccatttgtatacatctgcagactgaagtattagacattttaaattgcaaggtataattctgaacttgatagagtgaaaagatggacagccaagatgctaataatactgctgaacacttttacagggatactaaaattctgaatcagagcagatttgggtattttcaggtaagtgtatgaatacgttaaagcaagtatataaaatattaatgagcttctattattgcagttaatatatatcattttaatagtctacatgttatttttaacacaaaaatgacattaaaccaaattgatttgttacttttttttgttctgaaaacaatgggaaaatcaaatgtaatgaaaccaataaaggagtagcactgcctttctcttatacttgacccaaaatatctgccaagtggcagaagctttctctgagtagatttacagtttctaatcaccaaagcatactgactgacgaaaaagctaaaagacttgaagtctttacaggacatcctcagcacaggcagtccatcattaaggaagaaacatagttaaaaattacggtacattttttcaagatgttttgaagatttcagccaatgcaacagacacttactttttcatctaccgtttcaacacagtgtaaaaacaaatcaaagttaggcacttttggtccattagagcaatgtgtccttgtatcataggcttaggttcctatactataagttgcttcaaggtatagtatagttatacgtcttgacttagttctgacttgtcaagacttaaatgtcttgacttagttctgagaccctggcaaagaggctggtcagttcctgttttgagaagctgagtgtacaactccaaccacttcccttattgggctgtcacattctgggccactacatctgccgtaatcactctagggccaggaaccagaaaaaaccaaccaaccaaccaaccaaaccagaaacagccactacgccgtggagcccactgaacttgttcacatcagccaatctaaaacttgttcaccatggcgtcacctgttcctttctgtaaaaaccacaataaaatgtgtgctcacagttgcccccttcaccttctacctcgtgactgaccccagtgcttctcgagtggtcctgtgtggtgtgctgtgtttgtccagggaactgtgagcataacaaactgtaaaactctttccattttctctctcttgatctgcatctggcctcaccatctcacacaaagtaatatagttaaaatataatggtacacaacatattgattttagtcaagaaataatattaagatcaactactgtttcttaattattatgtattatttaagtgccacattggttttaatgatcctgatactaatccccagcaatagttctgataatttattttatagccacagtccatttcaatttccaggatgctgtaattgaccacagacatatgtaaactctgtatgggacaataattattggaagccaagttctcgattactgtgctaagtgaggtgggatacttttaaagaatatatgtttggatctagtaaaggtatactaagttattcagattaatcaattcagtaaaaactccacaactctgtaaaagcatcaaacagaggaaaatatagtgaaaatgttccaagacaacttctgaatgaaagcttataatgagaaaagctaacagaatcttggagcaccaatacttcctctttcctggatggcatttacaatactgcacacttgggatctgaccctgttaccactgagagaaaggggtgtggtggagagatcctctccatcgttgatctggcatcccaaaagagcatcacttcaaggttaaagtgaaccatatctgaaagcatgccacttctctcaaagtcacaggactacagggaagctactttggttatgaacaaagcagaagaaaaaacgtattcttctgtggccacagaccacagatacacctcaaaattaacaaagcccagaaaccccacccttagttgaagttctcacacccagtagtgctctcaggcacccagaagaggcaaaggcaaagattctctatggaagctttacaacaaaaattttcaatggcaattactaataaatagatagagaaaccagataagatgcttaggaaccaaaagaaacagatctgtctgatgacagatattggagtggtcagaaacaaactttgaaactaaggaatacaataaaatggtacaggacataaaacacaaaatgatcactctaagaaaggaccaaactgaactgatagagcaggaaaactcacttcaagaatttcataatacaatcaatcacaagtattaacagtgcaatcaaccaacctgaggaaagaatctcagagtttgaagactggtttctctgaaataactcagataaaaacaaagaaaaaacaacagagaagaatgaataaagcttctgagaaatataggattatgtaaagagaccaaatgtatgatctaggatcaaacctccacataccaatattaaccttgaatgtaaataggctaaatgctccaaattaaacggcatagagtggcaagttggatgaagaagcaagacccaactgtatgtgatctacaaggaacccatctcacatgcaaacatacccgtaggctcaaaataaaggaaaagagaaaaaccaaatggaaaacagaacaaagcagggattgctattctaatttcagacaaaacagtctttaaacccataatgatcaaaaaagacaaagaataacattacataatggtaaaaggttcaattcaacaagaagacctaactatcctaaatatatatgcatctagcacaggagcacccaggttcataaggcaaattcttagagacctacaaagagacttagataagcacacaataatagtgggagatttcaacatgccactgacagtattaggcagatgatcaaatcagaaaactagcaaagatattcaggatctgcacaggacatttgactaaattggcctaacagatatttatagacctctccacccaaaacaaacagaatatacattcttctcatctgcacatggcacatactctaaaattgaccacaatcagctgcaaaacaatcctcagcaaattaaaaaaaaaaatcatactaaacacactcttggaccacagtgcaataaaaataaaaatcaatactaaggaaattgctcataatcatatgattaatggaaattaaacaacctgcccctgaatgacttttggggaaactataaaactaaggcagaaaccaataaattatttgaaactaatgagaacaaagatacaacataccagaatcttggggacacagctaaagcagtgttaagcagaagtttatagtgctaaacgccctcaaaaagttagaaagacctcaaattaacaacttaacatcacacctagaggaacaaggcaaaccaaccccagagctagcagaagacaataaataacaaaaatcagagttgaactgaaggaaatagagatgcaaaaaaccatactaaagatcaacaaatccagaagttggtttttgaaagaataagattgatagaccaccagctagactaataaagaaaaagaaaagatccaaataaataatcataatgacaaggggatattactattaaccccacagaaatacaaaaaaaaaataacctcagagactactatgaacatctctatgcacacaaaccagaaaacctagaaatggataaattcttagaaacatacaaccttccaatattgaactaggaagaaattcaatccctgaacaaaccaatagtgagttcagaaactgaatcaataataaaagtctatcaaccagaaaaatcccagggtcagaaggattcacagccaaattctaccagatgtaagagaagagctgataccattcctactgagactactccaaaaaattgaggagaagggacttctctttaactcattctatgaggccataatcatcctgatatcaaaatctgacaaagacacaagaaaaaaagaaaacttcaggccaatattcctgatgatcatagatgcaaaagtcctcaacaaatactagcaaattgaatccagcagcacatcaaaaagacgatccgccacaatcaagtaagctttattcctgggatgcaaggttggttcaacatacacaaatcaagaaatgtgattcaccacataaacagaactaaaaacaaaaatcacattatcatctcaacagatgcagatcctctgtcatctgggctggagtgtagtggcacaatatcggctaagtgaaaccttggcctcccaggttcaaatgattctcatacatcagcctccccaatagctggaattacaggcacacgccaccacgcccagctaatttttgtatttttagtagagatggggttttgccatgttggccaggctggtcttgaagtcctagcctcaagtgatctgcctgcctcggcctcctaaagtgctgggcgtaagccactgtgcccagcctagaaaaggcttttaataaaattcaatatcccctcatgttaaaaaccctcaacaaactaggcattgaatgaacatatctcaaaatgataaaagccatatatgatagacccacagataacattgtaatgaatgggcaaaagctggaagcattccccctgataactggaacaagacaaggatgcccactctcactacccctattcaacatagtactggaatcctaggcagagcaatgaggcaaaagaaagaagtaaaaggcatccaaataggtagagaggaagtcaaactatctctgtttatggatgatataattctagacctagaaaaccaattagtctctgcccacaagctcttagatctgataacttcagcagtttcaggatacaaaattaatgtaccaaaatccattgcatttctatacatcagtgacatctaagcagagacccaaatcaagaacacaatcccattcacaaaagccacaaaaagaataaaatacaaatatagctaaccagggaggggaaagatctctacaatgagagtaacagaacactgctcaaagaaattggggatgatacaaatgaatgaaaaaacattccatgctatggataggaagaatcaatattgttaaaatggtcatattgcccaaagcaatttacagattcagtgctattcctatcaaactaccaatgacattcttcacagaattagaccaaaaaaactatttaaaaattcatatggaaccaaaaaagagatcgaatagccaaggcaattctaagcaaaaagaacaaactggaggcaccatgttaatgaatgaaaaactatactacaaggccacagcaaccaaaacagcatggtactggtaaaaaataagacacatagaccaatggaacagaatagacagcccagaaataaagtcacacacccacaatcatttgatctttgacaaagtagacaaaaacaagtaatggggaaagaactccctattcaataaatggtgctcagataactgtccatatgtggaagactgaaggtggacccctaatatcatatacacaaatcttcttaaggttgattagaaaattaaatgtaaaacctaaaactacaaaaacccagaaagataacctagggaataccatctggacataggccctggcaaagattttatgatgaagactccaagaccaattgcaacaaaaataaaagttgacatgtgggacctaattaaactaaacagcttctgcagagcaaaagaaaatatcaacagagtaaatagacaatctacagaatgggagagaatattagcaaactgtgcatgctataaaagtctaatatccagaatctacaatatagttaaacaaatttataagaaaaaaacaaacaaccccattataaagtgggcaaaggacaagaacagacactttcaaaagaaaacatacatgcggccaacaagcatatgaaaaaatgcccaacatcactgatcattagagaaatgcaaatcaaaaccacaatgagatactatctcacccacatcagaattgatattattaaaaagtcagaaaaataacagatgctggcaaggttgtggagaaaacggaatgcctatcctctgctggtgaaaatggaaactagttcagccactgtggaaagcagttaggagatttctcaaagaacttaaaacagaagtataccattcaacccagcattcccattattaggtatatgccccaaggaatataaattgtttttactacaaagacgcatgcttgtgtagattcactgtggcactattcacaagagcaaaatcatgaaatcaacttaaatgcccatcaatggtagactggattaaaaaaatatggtatatataccccaaggaatacaaagcagccataaaaaagaatgagattatgtcctttgcagcaacacggatggagttggaggccacagtcctaagtgaactaacgcaggaacagaaaaacaaatactgcatgttctcacttacaagtgagagctaaatattgagtatacatggacacaaagaaggaaacagcagacacctacttgaggatggagggtgggagtagggagatgatcagaaaactatcaagtactatgcttattgtctgtgtaacaaaataataggtataccaaacccttgtgacatgcaacttccctacacaacaaacctgctcatgtacccatgaacctaaaataatagttaacaaaccaaccaaccaaccccttgagaatatacaacagcaaattgaacattaaaaaagataatttgtaaaataacagatcagaagagactgtgtgactgcagcacaatgaaaaaagatgaaaaataaagagggtgagagacaaataaatgcaatataacagtttaaaatacctttgatcagaatcttaggaggacaggagacagtgaatcatgcaaaggcaatatttattttggttttaaaatcaacctcattgggatataattgtgggaaataaggtgcagccattttgagtgtagagtttggtgagctctgacaaaagcatacactcatgtaaccaccgctgcaattaagatacagaataagccacatgcggtggctcatgtctgtaatcccagcactttgggaggccgaggcaggtggatcacttgaggtcaggagtttgagaccagcctcgccaatatggtgaaaccccgtctctactaaaaatacaagatttagctgggcgtggtggcacatgcctgtatcccagctacttgggaggctgtggcagaagaatcgcttgaacccatgaggcagaggttgcagtgaaccaagatcgtgccactgcactccagcctgggtgacagagtgagactccatctcaaaaaaaaaaaaaaaaaaaaagatacagaataggtccattgccctaaaaagttccctcttcccttttgtagtcactgccccacccctcaaatcccagtcctaggcatccaaactgttttatcattataaattagaattgccttctctagaatttcacacatatgggatcatacagtatatagtcttctatatctgtttttttttcaatctcctttttgagattcatccatgttgttgagtgtatcagtggtttgttcctttttatttctgagtgtttatccatgcacctggtgatgtacatttgggttctcattttcagccattataaatatctacaaacatttgtgtacaggttttttgtgtcgatatattttggttttatttttggaaagagtcttggtctgttgcccaggctggagtgcagtggcatgatcagggttcacagctgcaaactcccaggctcaggtgatcctcctacctcagcttcccaagtatctgggactttaggcatgcactgccatgcctggttaattttattattttttattttgtagagacgaggtctcactctgttgcccaggttggtctatgtgtggatgtgttttcatttctcttgggtaacatctgtgagtaaaactgcatgtctgcatgatgagtatacatttaactttgcagtaaaattgtctattattactgagttgtaagattaaaaaaaaatcaagtactttgtcagatatactaattgcaatttttttctcacagtcttttttcattttcttaatggtggcttttgaaaagcagacattttaaaaattttatttatttttattttttattatttatttatatttgagacagagtcttgctctgtggcacaggctggagtgcagtagcacaatcttggctcaccacctcccaggctcaagcaattctcgctcttcagcttcctgagtagctgggattacaagtgtgggccactatacctggctaattttttgtatttttagtagagacgggggtttcatcttgttagccagagtggttttgaactcctagcctcaagctgatctgcccaccttgacctctaaaagtgttgggattacaggcatgagccactgcccctggccagaagtttttaatttaatatagtccactttatcaaattttttgtactttattattgtgtcttggaagaaatttttgcttatcataagattttcttttagatattttattgttttccttttttatgcttaggtctatgattcatttcaggttatttttgtgtatggtgtgatgtaatggcgtggcacgtaagctctgaaacgaacctcaatgatccctaccttatgaggtccttatgaagtctcacctatgtgggctctacccagggactcacttttaattgatagaatatggttaacgtgatatgatgtcactttcaagattagcttaaacaaagatcttgacttttgttttactttctctctttcaacttccttccctttctccctcactcctctctcctcactctgagggaagcaagctaccacattttagacccataaagagaccaacaaggcaaggaactgatgtctcctgccaatgccagttaagacccgaggcctgccaacacctacagagtgagcttgggagcagatcctttcctggtcaagctctgagataatgcagctttagtcaatgcgttgattgcaactttatgagaaaccctgagtcagaggcattctgattcagacatgtctagattcctaatcctcaaaaactgtgagaaaataaatgttcgctgttttaagtcactaaattttggagcaatttgttatgcagtagtagataactacacaaagcgttttcatcaagtttggaaaaaatttggccgttagttctttttttttttggagctggagtctcactctgtcatccaggctggagtgcagcggcatgatcttggctcactgcaacctctgcctcctgcctcagcctcccaagtagctgagattacaggcatgtgccaccactcctggctaatttttgtatttttagcagagatggggtttcaccatgttggccaggctggtctcgaactcctgacctcaagtgatccacttgccttggcctcccaaagtgctaggattacaggcgtcagccacggtgtctggcccattatttcttaaaacactcccacactcccatccctgccctcctgggactacagttgtatgtattttatactgcttgatattgtccctaaagtctctgaggctctctgtgcataatttttctttggtctttttttctcactatgtttcatttttggatggtttctttcgctctcttcaagttctctgatcttttcttgtgcagtgtatgatctgctgttaatcccattttgtgagttttaaaattctctaatatttttcatccacaggtttccattggttccttttttgcatcttccacttctctccttatcatcttcatgtgttcctttaaatcactaagaatatttacaatggctggtttaaagttctcatgttttaataattttaattaattaataaaaattaaaaaaataataattttatcccctctcatttctgggtgtgttttgatgcactagtttttgtttttctttttttctggttatgggtaccattttcctgcttttgtttatctattttgttggatttgttctggcaggtaattaagttacttgaggaccagcttgttcattttgaagcttgtttttagctttttcaagacagattttcaattctttttactctaggctagtttagttttaacaataggataaagtgatcctgaaatctttattgtatactctgggtgttcaacaaggatgttccactctggccgactggaactctcatgtctcttattactgcataaactcttgatgttttgtcagttcacagctcccaaagatgttatctttaatgttctagaagaaaacacctgtcaacttggaattccatacccagcaaaaatatctttcaagaataaacaaaaagtaaatatattttatgagcagcagttgagaattcaccaccagtagatctttaccaaaggaacttctgaaagacataattcagacataaggaaagtagtcccagatggaatgtatgagaatagtattgttcatatatatttattactttattctacattgcttctagtatctcattcagtaatatacaataaatatattactgttcatatatatttattactttgttttacatttattactgttcatatatagtttgtaacagtaatatattttttactaaatgaatagtaattaacctatcaacaataatatataagctgggtaagagaaattaatggtgctaatatgtttcaaggttcttgagttttctgggaggagaataaaagctttgattaccttcagacttcctaagtatgtgtggtataacatgtagggtagttaccaaaagaacatgagtaattaatttccaaatattggggaaaaaagtagaatgattaaaaaaaaccaaatgaattaaaaagatgagaaagaaaaaaaggaataaagcaaagatgtcagaagtagaaagtactaaataatacaataaaaacaaatcccaatatattttgaattacactaaatatcagtgaatgaaatggcctgaaactgagctatctagtgtttctaaatctatgaaacagaaacaattaagaaaaaaataactaaaatgactgcatatgtttaagaactttagaatttatatgaaaatgtacttatacataacatgtagattaaaaaagataataaatattagaaaataatttgaggccaattactcctataatctcagcattttgggaggccaaggcaggaggatcagtttcttaagtccaggagttcaagaccagactgggcaacataatgaaaccgtgtctctacaaaaaacacaaaacttagccagctgtggtggtggacatctgtggtcctagctacttgggaggttgaggcaggaaaactgcttgaacctgggaggtggaggttgcagtgagccgagattgtgccactgcatatcagcctgtgtgaaagagtgagaccctgtctcagaaaaaaaaaaaggaaaataatttgaactaaataatagtactatgtatatcaaaacgtatactaaagctaagacatagggaaaaatttataacattgaagaatgcatgcattaggtgaaaatttgagccatgcttctatttcaagaagtaagaaaaaagaacagcaacatgaaagaaaggagaggggtaacaaagagcagaaagtaataaaattatgtaataaacacaaaatagaaaagattaaaaatcaaaggttatttataaagagtaaaacaactgagaaactctgataagagtgataacaaaaaaaagagacaaggtacaataatatcaggaatgcaaaaggaagtattacagatgctgcagacattaaatggacaataatatgaaaaacatccaaaaatactaaaaatttagaagaaattgacatatatctataaaaatataatttaccaaaactatgtcaatgaagaaatataaaatctgaagaattctatcactgttcaagaaattttgattgactcaacgataaaaaaacactcctacaaaaacccaacaacaacaaaaacaacaacaaaattccaggccaagagatttcactggagaattctatcaaatattcaaggaataaacacttccaatactccgtaaaatatacgagattacagaaaaagaagggctactctccaatttgtttttgaggctaacataactgatataacttgagagttcaagaaaggatttcagtcaatctctctcatgaacatagataaaaatatattaaataaaattctaacaaatcaaatccagaaatatatataaggagaatgcattacaatcatgttggttttgtcacaggaatgaaaatttggtacactagcaaaatcaatccataaaatttatcccattaacagattacatagaacaaattcaaataatcaccccaaacaatgcagcaaaagcttttataaaatttaatatctgtaggctttgcatgctggctcccagcactttgggaggccgaggcaggtggatcacctgtggtcaggagtttgagaccagcctgactaacatggtgaaaccctatctctactaaaaatacaaaaactaaccaggcgtggtggtgcatgcctgtaatcccagctacttgggaggctgaggcaggagaatcacttgaacccaggtggcagaggttgcagtgagctgagatcgcgccactgcactccagcccgggaaacaagagcgaaactccgtctcgcaaaaaaaaaaaaaattaatatttgtgataaaagctcttagtaaagtaatagcaaaaggaaacttcctgaatgtgatagaggttatcaccaaacacagaaaatattatatgaaatgatgaaaattgaaagctttccttttaagattgggaacaagaataagaatcctgattatccctactctgtgcattgcattggaagtcctagctagtgcaataagcaagaaagagaaacaaaacatacagttatttgaaagagataaaactgttctattgatagatgatatgaccaaaatccaaaagattctacagcttttgtcctaagtaaggtcactggttaaagaaagtatcatcagcaacaaatagctttcacatttctgtgtataaacaatgatgagaaaatgaaattaaaataaatttgacaaaggtgtaagatttctacaaggaaatgaactttactgagacattaaagaagacctaaacaaatggagagttatttcacgtccatagattgaaagacttaatattataaaaattttaattatgttgcttgttctaaatttatttatagagtcaacagaattcaaactaaaattccatcaaatttatttaaggaacttgacatacaattctaatatgaatacagaaatgccaagaaccaagaataggtaagatacttttacaaaaaagaacaaggtaagagaaatggctgtaattaggtatcaggtcacttttcaaatcttgtagttgtttcaaaagtgtcttacaaaggtataataaataagacagtgtggtattgacacaaggataagcaaacaaaccaaaagaacataaaagagatgtcagaaacagatccacacacatatgaacacaaattatgacaaaaggggcagtgcaaagtataatagcaaggaaaagagagacttgtcattaaatgtttcagggatgaatggctacaacatgggaaaaacagaagttgacttgcatctatcctgtgttgttgtctttgtctattcatggtgttataacaaaataccataaactggatggttaaaaagagaaatctatttctcactgttttagagtttgagaagttcaagatcaaggaatttacatgcaaagatgaggtgaaaggacaatataagcaagtatgtacacaagtaaaatacacagatttggtcttacggtggttataaaatatgtccagaaattcttggagattcatgtcttcagaaggtaggccctaaaaccccttactgttaatgtggtctggatttagcaactcacttctaatgaatagaaaaatgtgacttaggagactaggtcacaaaaagcattacgtctttttgctttctcttgaattatttgctctgagggaagacagctgccaagtcatgaggataccaaacttctctgtggaaaggtcacagggctaggaagtgaggtatctggccataaataggaacttaggccttctatccacggaggtgtaagcaatcttggaagcagatcctccagctcccattaagtcttcagatgacattttgattgctacttcatgaaagaccttgtgtcagattcacccagataagccacttccaattatttcatgagtaaacgcttgactcattaaattataaaataataaatgttttccttaagaactaaatgttggggtaatttgttacatagaaataggtaactaatgcagttctagagtcacggaagtgggaatgaaaagatagaaggcgtttcaaaagaagaatcaataggactcggttactgaaagaagataaatacaaagaatgagtcaaagatggctataaggttttatatccaggagttaggggaatagtggtatcaatgaagaaagacggttaaagaagaaatcaatttggaaaatgtaatataaattgagttttgaaatgtagaaattaagataataacaagacatatggtaaatgttctatcgacagttacaaaacgagggcaaataccaggtaagatgtaaagctgcaggagggtgcagtgaagaattcaacagataattaatagtaaaggaatgaatatctttaaaaaaagaatttgataagatcagaagggcttgtttctttgaagcttgtgagtacataaaaatagaaagtaaaagaaaaattattcaaacatctggataaaataagcttggtaataaaatgtagagaagaagaggaaatgagaaggagaaactattttcactttaaatacaggcataggcatctaaaagccaataagggaaggaaggactgagtggtggggggagagagagagaaatagaaactaggcagaaggtttttggggggttggaaattgtaattttttttttctccaatgggtaaaattgagagcttcagaaaaaagagattagtaattcagcagtaaagctaataataaaattactgagcagcaaagagcaaatcagaataatctctgtgggaatagtaattcgacagtatgactaaaaaggaactgccttttgtgtatttctttcttagatttcagcattcgactatcttttattgtcgagatttgttgcctcttagaagccaacaaatgcagatatatttcattatataaacatttgctattacagaattttattttattttattttgagagggagtctcactctgtcgcccaggctggagtgcagtggcacaatcttggctcactgcaagctccacctcccgggttcacgccattctcccacctctgcctcccaagtagctgggactataggcatctgccaccacgcccggctaattttttgtatttttagtagggacagggtttcactgtgttagtcaggatggtctcgatctcttgacctcgtgatcagcccgcctcggcctcccaaagtgttgggattacaggcgtgagccaccgcacccggcctacagaattttaatcagaaatcattaaagattccatttacgattaatttttggttacaaatgtatgttccagtaaattgttattcactgctgagctttgaatcctgtcttctgtagcttatttcttaccttcaactctcaagccagataattatatttattcctaaaatctattatatttctatccctttttttttttttaacaattatagcccatctggtttaatatcactggtatgttgtccatcttcctctaaattgattcaagtccttttctttctcatctctactttgttttaatctttagcatttgccatatgtgggaacacccacattttgttcccataccagatctctgcctcagtttatgcttttgaggaggaataattcatgacaataatagatttgtctgtaattaaaaacaaaactgaaacaaaatttcctttctagagtacctacattataggttttttaaaaagtataaaccacagaacatttaaaataagatttagtaataaaaattgaatttataagatattcatggcatgaattaaagtgtttattggttaaatatatttaaccttatatattaaaatatacatgtataaaacctaagttaaaatctaaaatatctatagtttttgagatcattctttgatttttttctaaaaaacatatttcctacccaaaatagggaagtacctcaacacaataaatggtatatatgacaaatccacagctaacatcatacttaatggtgaaaaattaaaattatttcctctgaaggtcaaaaacatgacaaggatgcccatttttgccacttctattccatatggtactgaaagtcctacccagagaaattaggcaagacaaataaaaggcatcaaattggaaaggaagatgttaaattgtccctgtttgcaaatgaaatgatctaatatatataaaaccctaaagacctcatcaaaaaactgccataaacaaatgcagtaaaactgtatgttcaaaacacaaaatatcagtagcattttccatacattaacagcaatctatctgaaaaagaaatcaagaaaacaattccatttacaatagctactaaaacaataaaatacctaggaataaattcaaccaagaaggtgaaaaatctctatattgaaaactaccaaaaactgataaaagaaatttaagaaggcacaaataattggaaagatatcttgtattcatgaactgaagaaattaatattgtcacaatgtcgatactattcaaagtgagctacagattgaatgtaatgcctatcaaaattccaatgacatttttcacagaaatggaaaagatgatccaaaaatttgtatggaaccacaagtgaccccagttagaacaatcttgagaaagaaaaacaaagttggaggcttcacactagggctattatggcacaaaagaccaaatggcatttgataacatacagtgaacaaaggaaaggtagaataaacacttgatttttccttttattcatttttttcttttagaatgaattgaatctacagcatcttccaaaggtgaccaaagacttttttttctttacttaaaaccattttgaagtcatgaatttaaaaaatatgtttgatatgtttcaatttattgcacatattctttttgatatccagatagtccccacatgggccagggggagctaacttaagttggtccatgggccattttgatgtgaccccagtaatcttgataccttctctttgctttttgtgatgacaaagtattttctaggcttatcttgtactctcctgtcccaaatctgtaatcaatcatttttccaaagagtcctagtttcttttaggagacctcattgcaactgaatactggtcttgtttttactgtttactgaaaagactgaactagagaatacacgttcttaacgagtaaaatacatcttgagttcataaactcttatttccaattccaatttagaactacaagtttattcaatttgagtttcttctcttttatgatgaaaaatttgtttcttaaagacttttataataactcaactgccttatcctataattataagtttcagaacaccaccatgaatattatttctaacaatatgactactagaaacagtttatgatttcttgcatttcctttaatccttaggctttatcccacacagtctaattactatgtttaatatcacttgaaataattcatctatgtagttaagccatcaacttcctatataattaagttaatttgtttaattttacttttgatttttaggtattgcttttcaaattttgatttaattcaaaaaataattatataaacatttatatagttccaaaattaagcttataaatctacaaaacaaggttcattcaaagaagtctagccttcattctgtcccgctctctcctctcagaaattacctttgaattattttttggctcacctcttcacttttaaaaacacaaatgtgtgtacatatgttggtttatatacatacatgtatataaacacacacaggcacatgcactcctcactcttagataataagtagaatactatacatactgttatattacttttttttaacttaatatacttcagatattgctccatgtgctaggattctaactgggattacagtgaatctataggtatattggtgggggagaatgaacataattataatatttagcattctaattaataaacatggtctctgcctttacttagactttctttaattactcttaatattatatatagttttcaaacaaaagtcttacatattgtttgttagatttgttgctaggtatttgatgttttttgatgtaattataaattatttttaaagttttatttttgaaatgtttgttactggtatgaagattacaaacggtttttctatattcacttaataatttgtctaacaattattttgggttttttacatattcaaccatgttgtctgttaagagtggctgttttctttctttcggttttgtcaaccttttatttctttttcttgccttagtgcactgattaggactccagtacaaagatcaatagaaatggtaatagtgaacttctttgacatcttgtcagtcttcaaaagaatgttattgacattattttttgccattaagaacaatgtctgctatagaatagatgcctttagaaaattaaggaaattctattcctagttttttaaggaatatttttgaaaaaataaccatgaaggaatattaaatgttatcaaatgctttttctatatctattgaaaagaccttatgatttttctcttttaataagttaatgttgtaaattatattgattttctaatgttataccaactttgcatccctgacattgagcctaactggtaatgatttttttttgttgttagttctttagtgctctttgtagatgctttgtataattcaacttttttacttgtggtggagggttggttagaattgcctagttcaccactaactctttcattttaaatatatgtcattccaaccttccaccaaaactccttttattatggttaacaaagtcaccacatgatatcaaattagaaggtccattctcagtccttaccttactcaaccaatgaataacagatttttataaaacataatggttaagagcatagtgtctttacccaaactgaatgtaaaacctagatctgtgtattcattatctatgtgatcttatacaagttccttaacctcctttggcctcagtttggctatctgtaaaacatgattaataatgttatacactttgtggggttgctgtaaagattaagtacatgtaagttgcttagaaaaatgcacacattaagtgttcaataaatatcacccattattgcttattccttttctgaatttttatttttgatttttactatttgtctttatttctatttctctggatatgctttctcagtctctctcagtggaataattttcctaaactttacattttggaactcagtcctcacacagtttccatctctctatcctctttttcaacatgttctcattccatgactttaaaaatcatgtgtatgttaatgattcacaagtttatagctcttattgtaatctcctccctgaatatcaacttacatacataatttactagttgatatcctgacttaaatatcttttgggcagctcatacttaacaccccaaagcaaacttcccgtgattatctccaaccctttataacctagtttaagccaccaccattttatacttggactatcatagtactagtttctttctcccttctcttacccttgcctctttacagtctattctttttttttaatagattttattttttagagtagttttaggtttactatagtaaatcatatggtgatatagtagatcattcagtgatcacattcatctgttgaacatttaagtctgatcacatcactttgctcaaagccctctgatctcattcctatgttgaagctcttgagcttcccatctcattcaacacaaaatctcaagttcatctgaggaagggtcagagaattttttttcaagggccagagaacaaatatttcaggctttgcaggcgaaatagattttgttgcaactatctaaactaatatatccaacaaaaactattacattttctgaaacatgcatgaaatttgtaaaaaatataatatttgctttggtttatgacataatatttttatagtagtttcataaatatttactgaagaaaaaggtaaggtccagaattatacattttttaaaaaagattatggcaaggacattaaactataggttaaagaatttcttctgtaaaacatgtcaaacaactaacagtagacttactttagattattgattctaatttctgcactttcagtaagtttcttcgtttcttctttccacctattggctgccttctgttgagtcgctaggagatgcctcagttcaacaatggaatttctattactgtcttccatctctctcaattgaacttcaaatccacgttcctttattgaaaattcatgttccattgtactgatctaaagaataaaatgaaaacgtattttctttttcttttcttataggtgctatacagatcaatgatatatacaaaaggaatcattcattatgttgtctgagggacaaaaatgtttggatgagaaaactacgtaagaaatcaagtttggtcaggtgcggtggctcatgcctgtaatcccagcactttgggaggccaaggtgggcagatcacgaggtcaggagttttgagagcagcctgaccaacatggtgaaaccccatctctactaaaaatacaaaaattagctgggcgtgatggcacacgcctgtaatcccagctactcaggaggccgaggcaggtgaatcgcttgaacccaggaggtgggggttgcagtgagctgagatcgcaccactgcactccagcctgggtgacagagtaagactctgtctcaaaaaaaaaaaaaaagaaaaaagaaaaaagaaattaagtttacaattggtcttcattacaaacgaaaacttataatgttatgtcagtaaaactagaattatgatgaactatatatttttgcaacactttccctaacaccttaaaatgccagtaaaagaaaagtctatttattataacataacacttctctctttatttactctgatttctgttgccagaatccaaggaaagtgttgatgctgttggtatctgagttaagtatttactcaaaccacttttgacttacatactaaatttgaaactctttcaaagggctttgtaaagtcaaagataattatatacaggaatttctttaccacttcagctccagtattagtgaatgattaatgaatgaattatttttcaggagaaagagacaatataaacaatgattttgaaaatctcttacgaaaatgtcttcagtacacttctaagaatttatgtcattatagtaaaagcactttaattgcagcatgaacttataagtaaatgctctttggataccctagaagctttctctgctggggttcagggagagaattaagccctaatgctttaaggcatccaatgtatataatgacttgcgttctttcatctgtgtctacaatgtaactacctaagtaccatttttggggaaattgagaaaaaagttactgcaatatttttctatgttttgtggttcagatgaaaaacacttgtggaaaaaggcagcaaggtgatttgacttccttattgtactctcaggccatctatattttgctatactaaagaagtataaagaacacttattttgtgatactttaattgctttacaaatgtccacagctggctagacttctagtaattcattaaatacagttactttcaaactcaaaaaacaatgagagtaattcattaaatacggttactttcaaactcaaaaaacaatgagatcaactttagtgtgtcaaaaaacacaaaacaaggcccaacaacaacaaaattcttggctcactggagcaaactgcaaacattctgtccttgccacccctgctaaatgcaaaatgcttcctaaaactcttcaatttgctttctcaaatagtacacatgcagaaattgaagactttataaatacagacactggaaaaccaatcttggatgtgttagttttgtgttgtattactgctgtgcaagcctcctgaggccacttgacccctgctgctatcttaataatttttgaattattagattctgcaaatttagattgcctgccctttctccttcccttccttaatcttcatctcctctggagaagtcatgttggtctaacatctcaggtggaaaacaaaaagtacagcccctgtgagttctttcttatgaacacatgttaaaaactgatctatgggccaggtgtggtggcttatgcctgtaatcccagcattttgggaagctgaggcaggcagattacttgaggtcaggagttcgaaaccagcctggccaacatggtgaaactccatctctactaaaaacacaaaaattagccaggcgaggtggtgggtgcctgtaatcccagctactcaggagggtgaggcagaagaatcgcttgaacctgggaggtggcagtggcagtgagccaagatcacgccattgcactctagcctgggcaacagagcttctcaaacaaacaacaaaaacaacaacaacaacaaaccacatatgcacacaaaactgatctatgcatctgtacagttttagaatttggctgcctagttaactccccattttcacttggaaaatctatttatcgtttcacaagctttgctttaagaccctttatgataacctggtccctgcttacttttacaagcttgtgttgtgccacactattcccttgcctttcttttatttccactataatgcctttttattctttggttcttttcacatgctgtttcttttgcctgaaataatctctttctgcttacctatttcaacttttggaacacagtacggttgtcaaaacatatttgcagattgaatggtggctttttgatgtcaaaattcagtctcgaacaagcaccatagcctttagtatatacaattcgaattactacctaaattggacaggtctgtggtaatgctgacaggctaagggccacaacaactgatctccgattacaaaaattctattaatgataaaattcagaatgttggatgggaaaaggggttttatggtctctcttctttcttgcttcttccttcctttacagagaaatatccacacaagtagataactgaattgctggaaacgactccatttcttaattttagatggtaatgaggcggaatttagaccatgaagaaatggagagccctggcaaaaggagtggttagaaaaggagaaagcgagggctgaaatcaatgcagtggcattaagatcaaatgaaaacttcatatgataaattgttaaggtttgtagccaactgacctcccaatatctcactgtctttatctttttggcttctttcagtttatctactgaagatcatactcttttgcaagagggagaaaaacagcaaggtgtaggtgcaccaggttcctattttgtcaaagaaagaatcagttacaaagcaatttatcttacagccttcttcctccataaaatagaattatagctagttagttaagacgttcggctctttatcaatggctattctcttaagctagatacagatttggtgagatatgtggggtagataaactttctattactcttttgttgtccataacatcagttactatcctgaaatgttaaagacggatctagtggagtactagataggaaaaattcattgattccatccccactcattataaaaaaaagaaagcaaaacaaatacatattgtaaaattatggaaaataacaaagcattaaagtgaaatgttaaagacggatcaactggagtactagatagggaaaattcattgattccatccccacccatgattaaaaaaaagaaaacaaaacaaatatatattataaaatgatggaagatacaaagcattaaaaagacaactataaggtccctctattcccaaaactcagataatcccttctaacttctacataattgtttttatttatgaattctaaaattgttattacagtatgtaaaggattactacatgtatgtgtgtatacacataaatttttcaatcatagggtgtatcaatataaatgcattataaattatttggaaatatagtttttaatgacaatacagtatcttattaaaaacatatacactatatgtcaaaaatacatatgtgtacacacaggtagtaatcctttatacactatagtaacaattttaaaattcataaataaaagcaattatgtagaagttagaagtattatctgagttttgggagtagagggactttatatattttttttaatgttttgtattttccataattttactatacatatagatgtaacatatttacttctagatatttaggttgtttctaatttattataaataatgctgcaatgaacttatttatgaaatattttaattactttcttatgactgaattttagactctaaagtaaatacgtaccatttaatacttttagctgcacgttcacttagagatacttagcaattaattaatggtgagtttaaactgcttactgcctactgtttttttttcttagattgcagattctgttcaactctcacatgattttttattcggttacaaatagttttctcttatatttttaaaagctctttagataaaagcatgggaaaacctgcccccatgattcaattacctcccactgggtccctcccatgacacactgggattatgcaactacaattcaagatgagatttgggtaggaagacagccaaaccgtatcaggatgtatgtatgtctggctttaaaagataatgctacattcccagcagtatctatcaaagttctaattgctttatattcttaaaaatacttgatatttttagtctttttaattttagccattctggtggtgtgtagtgttatcttgtagttttaatttaaattctcctaaaaaataatgaagttgaacatatttgcctatatgctattttatgaagtgcctacttaagtcttttggccttttctggaaatggagtatctatttttttctttattagctattagctgttttttccttattaatatttttcttattaattggtaaaagtttttatattttggatatgagttctctttttggttatatgcactacaaatactttctcccacttttccctttcttaatggtgtcttttggtgactaaaaatatcttaattttagtgaaatccagttcagcttggatttttcaccatggttagtgtttttttgtgctctgtttaagaaatatttcaaacccaaaggcaagaagattttctcctagaaactatcatttcacatttcacatttaggtctacaaagcagctccaactaatttgcatatatgctgtgatataggagttaagttttatttttaaaatatggatctgactgatctagcaccatttgtgaagccagttttccccccactgaactgcaatggtgcctttgttataaatcaagtgattatgataaatgagtttgtttctagactcaattttttgccattgatcaagttgattattcttatgttgataacacattgtctaaattattttagctttttatcaagtcttgatatctggcggtatgggtcctctccttgttcttcaaagaactcccatagtctaaaggtcaaagtacaaacttctttttaaataagactctctttttcatttcggagttcaaggttttacaaataactagggcatttcatacctgcaataggaggcattcaataaatttatgttgacatgaattaggttggaatatgacttcttaggagtccttgcagcaataaaaaccaaaataaaacagtgacatgacctcttcatattcttactatgaaattggaagatgtagatatttatcataaaaagttagtgccactttttacaaaagtctcatgacatggggaaaggtaagcaagatgttgatgaagattgtgttacttgaaagtcccttaaaaagaggatcaccttcctattaccaaaccatataagcatcagaggagaaggaaataagagagaaaagaaagggaatttgttttagatgacatttttgcctcttgccttcttcctgccatggaattttcagactagttatgaatggttctcagagcctactgctttaacatcctctatacagttagttttagagaagttcaacttttcaaaggctactacagagagagaagagaggaaggcagtctgtaaagttatctaatccatggttttgctagtgctgcttaaattgctttggcaggaatatcagtatatttcgtggttggaaaagaatttttttgtgtgtagcaaaggcaatcattttcaagtatgcctgccaagttctacaacacagaaatgattggttaacactctgaattatgatttagtgctatctgatgagaaggcaaaaaaaaagggggccttaaagatgttttgctaggtctctctaaatattctctatactttgattttcataagtacacatttaactctagtcttgaaaatacctttactttggcttttttttgagcctccagggcaatcttccttaaactctcagtctctttccgtaactgtttattttcttgctgaagttttagcctttgttcactgacaagcccacagttctctctctcagactccaatacattttgaagtttctgaatcatttcttggtaacgtgatatttcttctgaggagctgattaaaaaacgaaatgaaaagaatccttaaacttaatgatctatagtagaagataaaagtctgtctacattttatcacatggacttttgtttgctttattctgagccatttctttccactttagactgaaactatgtggtttcaaaatgttatgttataccaggcaaatacattcaacttaaatatattcaaattttaactaagaacagatgaattgaactgttatcacttatctagaaaatcaatgtgagacttctttcaaatttgtactaacattaagaatcactgtgtatggagaacttcaaggaaatgaactgaagcaacaaaaaaaggatgaagcggataataaccaaaactcctttacttaatcaataaactccatggactaacacaatagctgactatattactaaattataaaatctacttttatatttttccattatatgtcttagaaatactttttataaacttctagttctgtaaacttcttgttttatcataggttaaacggattatatttcctgaactgtctcaacaatggaccactgatcactgggtgagacaacctctatacattaatgttgcttcaaatcaatatactgctaatttttattcctatcttttaaaacttccatcttttcaataacagataagcactgtgaacattccctggttaataggtttcacagggaattgtatggaaatgctactaatattgtgaaagtttaagaaaactactagttaaaagtattttgcaagcagaaaaatacttaaaattcttaaaataaagaagcaactttgacctggtggcagttttatcaccatgaaccactccttctgtcctattttggcatgctgacctgcccatatctgccagtgctttgggtgaacacagttagtgactgattttctttgatctctacctctgcctttctagatctttgcttccccagcaactcccacattcttgtaaactgtttcctacattaaatcctttattcccgcaatactcatagtcttttttctgtctaaacctaggctgataaagttcctaataaaatgacatatctagggaatgataataaaaggatgctaacatcagaagatgctgagatcagaaacaaccacagattgtaagcctcctaatagacgtccacaatatcatcatctatgaagaattcttccaaaaacaacaacaacaaaaaaagaaagctagaccagatcaagcctctgggtctaattgctagtttttaggaattacatgagacagagtaaatagcatcaatatacaggcatgtagtggaggaaactctacattactaagaactcagtttttaaaacaaattatttgcaacaacaacaaaaatacagaaaaggggattcccagagattaaaggagatgcaagactacagcactccaaacattcctgaaattagaaatggacaagagaactcgcactcaagagaaaccctttaaatgaagtaactaagaaaaaagttcatcaaatatactttaaagcacatatgaaaacttaggagaaaaactctttgtatgtggagaatgtgggaaagccttcattaattcctcctgtcttgatgaacgcgtaagaactgatactgaggagaagaactctgcttataaaaagaatgcatgggagcctttagtcatttctcatttccttaatgaaagaaaaggactcatattggaaagaagcctggtaaatctaaagaagatgggttaatccttatccttcactcaaccttcaaaatttatcctggagagaagctttttgaaagtaaggaacatgggaaggtcttttacccagtcctcgcaccttattctatgtttacaccctttaggaaatatgtgagagttcaccctggataatagctttatgaatataaggaacacaaagaagacttcgatatctccttttactgtacacacgcaaaatactcataatgcagagacaccatgtgaattaaaacaaatgcaggaatgcttttattcaatactcctcccttaagagacatatggatatacacattggagagaaaccccgtgaatgtatggtattgggaaaagccttcatgtgtgatacgtctcttagtacatacaagatttatgctggaataaaccagctcctcctgcaggtttgatctggaagtaatcatatgagcagattatctgaaaaggttattgaaaattacacatatatttattaaacaaatttgcaagatctcttactaaaaaaaatctttattaatttaggtattagtatttaattaaaaatatattttgaacacatatagagattgtgattttaggcaattcaaataagaaaattttgctatattaggtaataccgtcggggtggggaggtagaaaaataaaatggtatgtcaaattatgactttatcattttatagataataaaatatacaagatggatcattatagaatattcactataacaagaaatacactaagtacaggtagtataaaagaatataagcaagctactataatagctgcacaattggtacaaagacaacaatattataaacatcctatttaactgccagaaaggatacatttaaaagaaaatggtatgctactgttaaatcttttcttcctgcagaaattcgctttcagaaataatcttgaataaaattatatttggtcctaattgtttttttcaacataagatatattgtaagtcctaccaaaaaaaagaaaaggtagcgaatctgtcaaaaattgtgtgaattctgaagatgttatcatagaaaatccaaaagaaaaacttactcagtttcaagttgttttattctattttctgctctcgtaagtcttagctgaagatcatcttttgaacgctctgaaaccaggaatctttggtgcatttcttccagttttctgtaatcactctcatttcctctgccttcacggtaaatctgcagaaaaggcttattaggtatataatattacagaagaaactgtcttaataaacagtttagaaacagaaatcaatggaagaaataaaaagccatgattatgtgttcatttgttctgaccgtaacatatgaaacatatcaataattaaatctggttctgtcacatttacaaaataaaatgctaaaaactaatatataaaataataatagttttgagaccagcctgggcaacatagcaagaccctgtcatctaaaaaaagtattaaaaaattagctgggcatggtggctcacacttgcagtcccagctattagggaggctcaggtaggaggatccttgagcccaggagatcgaggctgcagtgagccatgatcatgtccactgtactccagtctggataatcgggcaagaccttgtctcttaaaaaatagaatttatttttttggaattattcatgctcatggtaaactatgcaataatacaaaaatgtaaagcagctgaagtaaaaataaatgtcaacttagagataaccactggtgattctttgatgagtaccgttcaatacaatcctcttttccaatattcaaaaataaagatacatgccatggtgcaataactagaactctctgcaagtgactccagaatctcactctgggttacctggacaatgatctagctaggatggggcttcccccttcctcggcagtggtggttgtacctaagctcagctttccatgcaatggggctccctcttacagcacaaggtctgtaacatcctaagagatccaaggtctccaggtgtaagcagttcatacgttgaagcaaatcctgcacacagctacccccaaaatctagactgcctggccaagtaacctgtgtcttccccactgacaggactgctttgtcactctctataaaaacatggagtatcagcacgtcaacattccactactggaatacagatctaagctgcagacccagcagtactttgaccttagaacactggtctgtggaacagtgggagaataaggcgctgtgctttctctttacctgttgtcttttgccttgtaagttttacatttccccaaaagccttttccttaacctttgccatgtgatgttaaaacattcatcccaaaccctgatgtgtaacaggtggcaatctaaatggaaattgtacgcagatggaaactcagaagggacccaccttgcaggagagtggtaaccaaaagtcctattttgaacacatgtattttttttttcacaaatggaattgtacattatgttttgctttgtgtattactcttttactgatgtcataattttttcatgttcataatagatatagaccataatttttacgctacatagctctcctttgaaaatcaaactctgactctaccatttaccactttttaacattgggtaagttacttaacctctctatgaaagttcttagtgcagcacctaaaacacagtaagtgctcaatcaaatttggcctccttttcttttcccaaggtactttacaagagcaggatattactgctaataaaaaagcatatgaaagagatgaattttaaactatggagttctccctatagtttttctgaaatatcacgggggtaaatattcttcctaagtgtgaaattaaaatctgtacttctaaaaggtaaaaatcatagcaatgctataattttctggttatatatacttgttttatttatagatggcctaagcaccataagagctaaaataaaactcaaaaagaaaggaaagacaaagtgaaatttcgtaggatgaggtttaagcaagaaatataactacttcacaaaatttatatctttaagtacaaagttcaaagaatacagccgcccttggaaaagaattgtatccaggcaacatcagtatttaactgtagactctgaatatatttaagaaaagtgtgaggctgaggcaggcggatcacgaggtcaggagatagagaccatcctggctaacatggtgaaaccccatctctactaaaaatacaaaaaaagtagccaggcatggtggcacacgcctctattcccagctactcaggaggctgaggcaggagacttgcctgaacccgggaggtggaggttgcagtgagccgagatcatgccactgcaatccagcctgggtgacagagtgagactccattgcaaaaaaaaaaaaaaaaaaaaaaaagaaaagaaaagaaaaacttaccaggacaatactaacaaataaaggaattgctagtagatggcatgatggaggcagacagtaatgttgcatatttgcagttgggttttaggtagttatatttcctttttctttttaccttttctagttcttcttccactgcttttttttccttaatgactcgttcaatttggccttgtttttcagcacactcctataaattcaagtcatattgtaaatatatacatttggtaacatcttaagaaaagtggggaaaaattataatttgttcataatgggaatatcatagttatcaacacaagtttaaggttatattgattaaaaacaaaacaaaactcaatatttgaagagcaacctaacccaggattgcagaaattgcctccagcagtaggatgccaaggagttctaattaaacagactgaggttgggggattccagggagaaaaaaataaatagaacccctttctcatactatagattttcttttcatatactcttatcaagtattttgaaaagggaacatagaaccagatagtggcacaaaaccctcagggataacctatggcctaaaggatatgtgggtgtataaattctaaaaaagttaacttttttctttacaaaaattacagccaacagaaatactaaaaatattttattagcatgaacataaagtatttctgctcaaaagattttactctgtatttagcaagcatatcaattagataataaaatttaacattttgctaatgcacctaaaacaaaaaaatcataattattagttcttcacaattatttgtatttatacatttattctggagaatgggtaatgtgtatggcttgttttttttttttttttttcgtgagacaggtgcacatgtgtatgttaataggacagtaatcagtgcagggggaggtcatctctgccccaccctgtttgcgacccactaaggctggcctccactgcagagtgcccctcattctgtgcatttgcatttctgtcccttttttttaattgttatactttaagttttagggtacatgtgcacaacgtgaaggtttgttacatatgtatacgtgtgccatgttggtgtgctgcacccattaactcatcatttagcattaggtatatctcctaatgctatccctcccctctccccctaccccacaacagtccctggtgtgtgatgttccccttcctgtgtccatgtgttctcattgttcgattcccacctataagtgagaacatgcggtgtttggttttttgtccttgtgatagtttgctgagaatgatggtttccagcttcatccatgtccctacaaaggacatgaactcatccttttttatggctgtatagtattccatggtgtatatgtgccacattttgttaatccagtctatcattgttggacatttgggttggttccaagtctttgctattgtgaatagtggggtatggctttttttcctcttttttttttttcccctaattgtgaatcatgctttggaggaacccactttgctaactgtacactacgtactaatgatgttcaattattttatagaagaagtgtatttcaatatgtttttaaattttaaagtaagcttcttttgtgacccaaaattaatcaccattgatgataatgaagatctttaaacctgttacaaatcagttgacaaatttaaatttaatatcttttattaagatagaaccctgagtgtatacaaaatgcaacattaatattccacatattcatatagtaagttgcttatctaggagagggtagtttcagtgctaaatttgggattttacctacattcgtaactcctcccatgtgatttttaatatatatgttaataacaaagtctggctcacacttctggggctggcaagtggtatataaagaaatgcatgtgtaagtatgcttcatatccctctccacccaatccaccatttcactgacaaatgatgatggcctaaagaatatttggttaacctgggggtaaaaaaggtaaaatgagacagcaaagtttaagcctttagagagaattaccatactaattctagtagaaatgcactataatactaaagcaaacattaaaaattactattacaaagtttttagagatatttgcttatcaccactgacatgcctacctttgggggaaaatatgacaaaataatagatattttttcaggtactcatggagtatttccaaaataatactctataaaagaagtctcaatacatattaagaaccaaccatatagaccatgatctgtgctgccgacctaaccaaatgagaaatcaacaataaaagacagtgtaaatcctcatgtatttagaaactaaaaaaaagacttccaaaaaattcatccatcaaagaaaagatcataatgaacattttatgttacttttgtaagtttgaacattttataattaattttcttatttgatatagattaatagcaatctgctacatggcagaataaaaccttgaatattcttaagataaactacaccttaccagagaaaacaaaggctgttaggtacgtgttggtctccaaagggagatatgtagcttgaaatgtaatggctccggctttttcttaatctattaaataatctgcacactcatctaaaatacaaatttttctccttcctgtgagcataccttacttttggatcagcaaaagtatgcataacttccttcctggacttcatagtgtaaataaatagtatagatggatagtatattatactaatactattagtctagatagtaaaattgttaataatagaaaacaatagcaagcatcaggttattatgcttcaaactgtagcttagattttttgagaaaatctgtcttaaagtagccaaatatgttttcctttgaacatatttttaacataatacttcaaacttttcaattacacagtatagttctccccatagaatcaacatgactatgagatgtttcatatctttagaaaaatcacttagctatgaagtagaattgttttactataagaaacactttttgcaataaactgaaattgtcattctttttactctaaagtgagtttaatatagctctggttgttacacagctaacaacgatttgaaaaatccctggaagtcttagccagtccttgttcccttgagaatacagaaagaatgaatattcatgcccttgcagagtttaccatccattaaatgatcttggactggggtagtacccttctactcctctttttccacaaagatacgaatctcttgatagctaatcagcccatgaaagaaaacaagcaaaataactgggtgatagaaaaggaagcaaaactccacaacaacaaaaaattacatgtcactaactggccacattgcatctcactaattttacttgatgttcctacattattaaaataagtgacattaaacaaacaaatacaaaataaatattccttgttctattacatttgggaccaatacacaatgattaagatcccgtcatgtgctctccaaagtttgtagaatggcgaaagaaaatgtgatccctctttcagagtgtttaaatataccattcagttgataaacatttaaaaatatactctgcaaaacactgtactaggcaagcaacagggaaaataaaggaaggcgtaagactctactatgttgagatgcttacaatctaattgcagaggtaagattttcatggagagagacagagtgtgtatgctcaacatacacctaaagcatgatagttattacaagatatgattcattgctaaattttgtaacagagataaaaagtgatacagggagtcagaaaagatgaaagtttgtgaagttataaacattttctcaattcttgaaaattgttatacttttattctcctataagcaaggttattaaatttcattacatcaaatcttcaagttaaacttctatttccaatctcacctctagccacacaagtattcttttcctctcccctcttggcctactcattcctcagtattcatttctttcaggaagctttctgtatttcttccttcccactgttatatatactttctctttctccttggtttcccagataaactcagcatatgataggagctacagctagcaatagcatcctgtgcattctctgtcaaagacaggtagttacagtaaaatgtgataaatgccatctatctttcctgctagaacataagccacaaggctgctgcaaacatgtctatctggattttcacttttttcttagcacctagccagggcttggtttaataagtatcttttgaatgaatgaatccccaatagtatatatcttggcctttaaaataagtaatatttggaagaaaatatcagtatagtcaaacataccatttgaagggctgaaagttcttctgttaatcgagaaatttgtatattacattgttttttggtgtttgcaacctgtaaattaagacatttactcattatttggttctagaataaaaatgattaatatctgataaaaacactcaggataataattttgataaaaataaaattgtaacttttagggcataaaagacaaataagcacataatatattaaagagccaagaatttgccatgaaagtggaaggagagtgaatagaatggtatatccaaaaggaccgtggttgtcaaacattttggtcataggatgcttttacccacaattaaaaaaaagatcttttgcttataatgggttctatgaaaatctaccatattagaaatgaaaacagaaaatttaaagacatttacctactaatctcttaaaaagtaatttcttaccgattaacctgaacaatatttttataagaaataagtatattctccaaaactaaaaatttttgagaagagtagcatttttaaaatacttttgcaaatttccttaatgtctggctgaatagaagctagattctgatatctccttctgtatcaacctattgtgttgtcacatatcatacagcctctggaaaacaacactgcacacgtgtgagagaatgactgaaaaaggcagatgatgtcttaactacaattatagaagtaggtgtgaccttgtggcctctctgaacaatatttttgagaactgctgctataaagcaagtcaaaatttaattaataacttctaaggttttgggaggccgaggtgggcagatcacgaggtcaggagaccgagaccattctggctaacacagtgaaactccgtctctataaaaaaaaaaatacaaaaaattagccgggcatggtggcaggcacctgtagtcccagctactcgggaggctatggcaggagaatggcgtgaacctgggaggcagagcttgcagtgagccgagatggcgccactgcactccagcctgggcaacagagtgagactccatctcaaaaaaaaaaaacaaaaaaacaaaaaaaaaactttaaaggtgcttttgactcataaacagaatactttttaaataatacacaccacatcccagtattaaattacttttacatatgaagatatttaaattaacatttaataacatttaataagtaacatttaataaaatttaattaacatttaaatatcttcagaaagaagactattaatgtgcacagagcattttgaagagttagtcacatctcatcaggatttcgctatgacaataaatttttctaataactattcatgctttttaaaaggactgtgaagaatactgatgccaatagtatatcatcagtaaattttatgatctaaaggtcttcgagaattttctagtacaagatggactattttgaaaatatgatgtaaactttgtttagaacatttacaatactgccatgtactttatatggttaattaatatgagtgttatctttttgaagacctgccaagcatattatttctgggtctattttagtttttttttttttttttttgagacagagtctcgctctgttgcccaggctggagtgcagggtcgtgatctcagctcacggcaagccccgcctcctgggttcacaccattctcctgcctcagcctccagctgggactacaggcacctgccaccacatccagctaattttttgtatttttagtagagacggggtttcaccgtgttagccaggatggtctcagtctcctgacctcgtgatctgcccacctcggcctcccaaagtgctgggattacaggcgtgagccaccgtgcccggccagctcttttaaaggttataatttgatgtagacttttcctatgaataattatattaagaatcaatgtattctgtttatgaaatcagtaacaataacagatagaatttattgaggattaatgggtgttaggtactattcagagtgctttacatgtattatctcattaattctcacaaaaatccaatgaggttgttattatttccattatagatgaggaagactgaggcagagaaattaagtcataaatgttcctataacataaaaattttggttcttataagcctgtcatgtctgtcgctctctcacataatttctaaaatgtgttcttttcagtatctagaaatgatacagctaacttgagggtttatgtcaataagagggtacatattttgaaatacatttatagtaatcctggcaaagtcagacgaatcaaactactcatgccttttaaaaggactgtgtagaactattgacactgatggtatatcatacgtaaacttctaagctccaaaggtcatatggaatttcctagagttagcatctaatgaaacaaaatgtaaacttttgtcatgtgaggaaacacacatttcagtgaggtagtttactgtgattggggttttgaagtctgtagagggactaatatccttctctcatcctaacctcactttatataagcatttttcctctataattttatgaatagtaaggacatttataaaccaaatagtaagataaactattaagaaataggaaaatccaataatggcaccagccatgatttaaaatcaaaagtgaacaatgtatattttttacaaattttaattatttgagagatatctaagaaataaagtattttcatattttaaagaaataagccacgtcatatttttgttcaattttatagccagaacagaaatatgtgacaatttattcattatatttactttagtcaataggaagagatacatgtaaagttattctcaattcaacaggttaattctacatatttgaaggacatgccgtgaataatttgggattaaatgaaattcacagaacaatgctaaaaatagtgctatctctgggtattaaacttgtaattttaattttcttttatacatatttttcatttatacatattttctcatacatattttccatttctttttacaatgagtatatatcacttttaataataattttaaaagtttacttaaaaaaatcaacttggcaacagtgtggaactcagagggggcaaagacgcagcaaaatgcttggcacacaggaagtgctcaataaatacttcctgagtgaatagctgtaatggcagggaaaggctggctacaggaaatcaacaggaacacctaaggaaggaacaatctgggactgactatgagagtaagttcagtttcagacatgttgagtttcagatgcctggtaggactacatatttgaatagggaaataattggattttaggaagcatctgtattttccgtttgcaaaacatttggaatgaatgagatcacaatgcttttgaaaaattctacttagattatttaaagcttcatgcaaaagatgaccttcatcaacctcaaaatcaatttgaatttattttaggataagaaaatacaattagaggaatgctcataccaagaatactttaataaaatatttttatcattaaaagtataaagtttattaatatttattttaaaaatatgtcatcaagaatattttaggctatagtccaatgttacagtactctcaacttcacaaataggaaagacagagctcctgcagaaaggatatagaagatgacaaattaaaaagcccagggtttactttggactctgccttaaattaaaaattttatcttgggaaactatctaatttcagtcatataagacaaagtaatagatttttttctttacaccatgattctgtaaaagtaatagatttctaagaaatacttctgcaggaagaaatgttgtacagtggctttatggaaataaaaattctaccacttagttgcttgggagaaagcaaacattttaactttattttttctaaactgatggaagttttgaaaaccagtttaaatctacagttcacctaggagagaaataatattgcccacaaaaaatacagataaagaaaaaaaaggaacatctttattttatccagtggagggctatacagtatatcccactatcctactggagataattttaaaggaaaggagcctttactcagttcctttagttagtttttaaacacttaggttaataatttcatatggagtctttataactatgtaggcaagtattttaattttaatttacaaatatttaggtagaatttagtctttagttgtgacttaaattctgaattttaaatataattaaaaatccttacttctttcttggttcttatggtagcatcttgtacaaaccgagaaactgtctctttcattttctctatgtcttcttctttttgcttctcctcaagtagagccttcagaaaataatcatttcatgttatagataacattattattagtaaagataataacaggtgaaaacctatccactagtcacttccttattcaaaacttctgggacatctctacttgaatatcatgttgaaatcacgaatgatatttattttccctaacctcctcacctgcccttgtcctaactaaagacactttctctatggtatttatttcagccagtgtttctaacacccttctaatctctacagccagaaatcttaaaaccattgttgaattttccattttttcaagtccctatataaagtaaataatcaaatctaggtattgtatccttataagaatctcttgaatttctctctctttccattatttagtattattcaaattatgtcactcattaactcataatttgatcattgcagacactacttgttttgtctctttgatgtatttctataattccaatcatttccatcctccaccaaataaatattgccataatcctagctctgctgtcagtcacagtccatttccttgcttctctgagaagcaaaactctgtaacttgttcatctccaagacttttcctctcaatctcttttatactcccttgaatcaggctttcaccaccatgatctccatattgattatctataagtaaattttcagtacttctttaccagcagcacttgaaatatttactttcctctccttgttgtactttctgcatgtgattttcagcacatcacacacagtaccggttttcctcctatctcactgatcattcctcttcagtctacattgctgattcttcctcatctcctgaacctcttaatactggactacccaaggttcacttcttgtccccctctctatctgtccttctcttagtggtctaatcaaatctcacagttttaaatatcatttatatgctgacaatccccatatttacatctctaacacaaacctttttctgggcttggaacttcttcaattaggccaaattgaatccattttaaatcaacatgtaaatggccctgtgttctgttcccaccatcttccaaaggtaccatacacatttttacctctgtttttgtaaaaattgttttttaagataaaattcctccaccttaaacaagtaagctagtgagaagtaacagctgttcttatgtaataaccttgagggggagaaggggaactatgctaggctgtacttcctgccttgtttgtgtgatcggctgggagaacctttgactttgaacaagcaactgaagatgggaaccctctagcaattaagcaatgagtcaaagagcagcttaatattgtaaccatagacagcctctgtgagcgtctgttgacttaagatttgagtgagaagatttgggaggaggatgggcaatgagtgttcctactattttctctgtccactgtgctctacacaagatgtttatttttaatggcttggtataagagtgctcatacaagtaggcttcagagggtagagataaaaattttttcttgaccttaatttttccagctgatttaggtattcgacacaattcccaagcatattatgtctattgtgttcctcttaaccattctaaaagacagtattcagatcacagatgaaaatattagttgaaaggcatgataaacaccttagcatccccacagttaggatttagataattaattctttttttatttatgagcttctcaatatccaacttacactatattctgttttagagctctcttgaaaaatcctctgtaaaaagggaaataaaaataaaacaaagcatttcctttgtacccgtattctgcatatactaggcattcgatgaatgttggtaaataaattaatgatttaatgaactctacataagggaggccgcaaaataaacattaaaacatttgttttgtgacttcaataaacttaaatgtatcattcatagggaagcagtatatgacaaggaacactgtatttgacagcacaggaatcacaattgttagagaattaaaaaagaacagtgacatgaagccttcagtaaataaatctttaaagctaattaagcttccgctttaataaagtaattgagtatatgatgaaggggaatagagacgggtaagatttatcagattcaactgaataaaatatagggtatactgaagtaaagcactgttaacagttttttttttttaagtatgagactacaggggatgaagattagttacgcagcatctgggagaataagaaagtctgatatttatacattattttagaaaagaattgatgttttatcatatgatgatatctggttttaccatccaagaatatggatgattactaatgaaaagagtagcaatttcattttcatgcatttattcaacagctattgaatcccttactgtgaggtcacatgggagaatagtcaacattttattatatctaaacatatttactagctttcttacctgacttttttgaaggttagcttcttctaagagttgcatgctatttctggctcttacaatagcctcatatctctcattttctaattcattgcactttgcttgtagctctctggtctgtttttccagatgtgtattttcggttcttaattggttggcttcttggattgtcacacataatctagaaatcaataattacactgggaaagttaaacttttttaaagggaaggagggagatttactgagcatctactacaggacaggtattatgccagtaactttcacatgtattaatattttctcatttgatactcattacccttctataaagtaggttttactatctccataccttcattttaaagaacaacaaacatacccagagaggttaggcatttgattaagatcatagcgctaatgagcagtggggctgagactaagcctggattttctgatcctaattatgttatacttgttatggtatcacactgtattatatagttacatgacaatgatataaagcaaacccttaagaaatgagttgttctttacatttatatggtcttttctcttttctctcctttcatactctctacccagacaagctatgttaacttactaatgtatatcttaaaataattttctcaatattcatatgatcatatgtacatatatatatatactcatacacatatacacataaatatacacacatattatacatacaggtaatgacaggagctttttaaacttttgttataacaataaaaatcatagtatacacccttttctgtacttgcttttctcatccaataatatagaaatctcatcaagttagaaaggctccttcctttcctagtctaatgaatgtaacctcatttcactgttaatctgtatttctctattagaaagtttaggcatattttcctccttttgtaagccatatggattttgttctttgaatttcttctaatcttctttgcatatttttttccgatgggttgtttactttgctcttccctttataagaactctaaattaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggctcggtggcgggcgcctgtagtcccagctactcgggaggctgaggcaggagaatggcgtgaacccgggaagcggagcttgcagtgagcagagattgcgccactgcagtccgcagtccggcctgggcgacagagcgagactccgtctcaaaaaaaaaaaaaaaaaaaaaagaactctaaattataaatattaacccttagtctgtcctttatgctgcaaatttttttttttccaaatctacttttttgttgttgttgcctattgactctatttagggaatcttcgccacactaaaaatttaatacagctaaatttgactattttttttcaacttttgcgatttcagtttttataaagatggtctccttcatccatagattgtcagtgtaatctcttagatttcctccaaatatttccatgactttaatttttacccctaaatttttaatcctgactcatttgaatttactcctgaatatgatgtaagagaagagtccaatttaagttccagactaatggccagttgtatgaataccattagtaactaatgaatttaaatactcctattatcacccccaaaatatgcaaatatcatatatgcaaatatcataatttactagtagagtatgttgcattgatctacttatttattacatgctcaactcattttaatttgattattgtggctttataacatgtttggtaagatatattttataattttctttgttatttgttattttcagacatttctttttttttaaatagtagaagcagcagccttctctattctccccactaaccacatcaaaaccctcttcctgtcagtcaagtggtttattttctcatgtgtttggtaatttttgattaagttcttatctgtctaaacttaatctgtaggaatcctgaggggtctgtgttcaaaagtatttcccccaaaggtttactgttgcttcttccatgcaccaggactccctaccaatctgttgccactttagtgtttggggctgaggtttccaaatcaacaaatagtataatattaaacaacaggctcatatgagggcagagttatggttacacattctcagagaagactgcaatgattgttatgatttctactttccatttggctacatggtggaaatagttttatttgttggctatcgttgttaagaggcaggatttttttctattttagtcttttaatgagagtgtagttccttcaggggttccagcctgcctaaggacatttaccttcttgcaatattatacagatccagccctgacctccttggcagggaagtcatttatttatcattcttgttttagcttcctgtttttgtttttgtttgtacacttgagaatacccaactatataagttgagcatttaaatgtaattaaacagttcatgctataaagtttttatgctattagcattctaacatgtaagttaaagaaacaactttgaaaacaaatcatgttgtaattgatcaagatgcttacattaagagggtttttttcagaatatttagtctgacatattatgtgaatggaatagtctgcacaatcattattaatcattactttgttttcctccatttctaacctgtgttacagaattgttggtccactcaaatatctgcctcaaatcttaagaacagacgttaattgtatattatgtctactgtatctggcttttgttcttcctttatactgataatattagactttacctgagccaagaaaacagggatggctaagaaatcctcccaccttttttctctaaaccccctctatcattttgtgtttcagaatagagctaacagcataaaacaaccctgctctcgcatattccaacataagacccacctccatcccttctcatgactcccctaagactcatacacaacttgtttatccacctatgtaaaacctcagaccccttccttttctttgaaacattcctcattaatgagcattctccctactgcaatagcctgaataaaataatcttctgaattatctggtacatttggtctttcacagtactaaagactcacccaactaatcttgaagaaaaacaattgtatctaaattctgtttttcaatcactttcatattacttttctcaagctctcatatacatatatcctatggtaacttagcttttaaaatgtcttcagtctaggaagtgaatatttgctgaagaaaggcgaaaaaaatgatttggattctgattaagtaatgaatgatatataaatctgggtgcattctttagtaaatatgggtgaaatctcaaatatcaattcaggtggatagtggcagccaaccaagagtcaattatattattgaataattttctttccctaacaatttaagcatatgagtaatgaaggtcagaaggtagtgggggtgatgatacaagtaagtgatgcctttcagtcagacttcatttaagtttttacttattttttaaaaaccctatttttaatagtagtatccattggtgaattttccctactgatgataatcctttgtatttgtttaaataggtataaatgttgtttaaggacttttctctgtcatctacggagataatcagatatcaccagatactggccactcctagaattccagaacctaaaacactggctggtacaacagtaggtgctcagcacacattgaaaacatgatgcttcacctgtgaatacgaaagtccctcttaggagggagtcttacagacttttcttctaacaatgtatggaaaatcatacctagtcatactggggcatatctcaactatctcttagacctttttctactactcctgttcaataggcataaaaatagaagtttcaagtatgctgcatatgtctcctttatactgcccaaaattaccacaaacaaacatacaaaaattattaaaacttcatttcacttcttttcttctcaaatctaattattattgattccttcaaggaccatacttgttttcctctacctatattagttattctaaatattagtacacaaaaggcattgttaatgtgggaggggcaggcatatatttattgtcacttttattatagtcattgtgtcaaatgaaaagattttattaaacagataaattattcatttatagcaaaataaaatcatcaaagcacttggaaaatgtcatcttttcaagatgacttttagcatctggttaaaaattacttctcagctttagaaaaagacaaatatatattctccctacctaaaataaagtccacaatctaatatgaagtcatgtggctcaacttgtacaaagaaaaaagatttttaaaaaagtactgcatggaccattctgatataccagtgtcccatactcaacagtttgcaactatgatggtattggcatttgaaatgtgtagggacatttggtagttacaatgctaagagatgcgactagaatttagtatttggtgccagggatgctaaacatcctgtagttattggcacagtctcaaacaactaagaattgtctcactcaaaaagccaatactcctgttgaaaaacatgacaccaactgatgatggctatcagggcagagataagtgatgggtaaaggtatccgaagggccattgcaaattagaattcccaagaacacaagggagaacagtactggggagcaggatgcactagcaccttgccttctggaggaccaaaagaattgatgatcaagcttcagcttgcaagatttttctgacatattacgcccaagatgcaaaaagaatctacatttagctcttgaagctaatcctttttgtaggatttatggttcatgattcctaaaaaatagtttttaaaaataacattcctctcctttctttgccttccattttgatggtttatttctactgtaactgtattatttgcagaagtacagaattatagaggggttgaggtaatatcaaatttcctcttaactatgattttaaaattttaaccactctttagaagaaagaaagattttaggttactgagggtcaactatgttcacaccaaactctgcaggatgacctgaggagaaatgaaaataaaggtgtgctttgtgctctgcagtactgatacaaaagcatgatatcaagggttttatttgtttcctaaaaagtactggactaaatttggtacaattattctcattcaaaattaaattaatgtacttagtaaaggttctaaaatcatattaaacaaattatctttgaatatatattcaaagtatagcaatctgttgaatatagtttttaataaacaatgtcgattaaatcagattttacacctatgattatagttttgatttggagtttataaaatatttattctagtaaatatcacacactgaaactctattgtaaaatatcttttaaagcatatcaacaaagctaggtgcatttaacaatttaccttatttctaattgttttatactagactgtaactgctgtaaacgcctatctgatgcttcctctcttccatgggcagacaccacatccttctcctagaaaataaagaaactagaagcttactttgagtatgtgaaaattcaatacaccattatacagcataaagaaaacagctcatgctataaagttattatgctattagcattctaacacttacgttaaaagaaacaatatgactttggaaacaaatcatgtgtataataaaaaggaggggagaacttcatcatcaatcctgtgttaataaaaaatactccaaacagttattgcacatagatttctaccaatatttcaaactatttctatagtacaagtctaacaaaacgagagggatttctatgcagataatgtgcctttagaatatgctctcttaactatattattctatgtctcattaactatcaaggtaatcacagggtctttcttctttgacatagtgatgatttgacctatattaataaattttatttgtatcaactttctaaggaaatttcttgttcatcttttcttgcttcatgtgttaacaaatattttttatgatgccataacttttttttttttttttttttgagacagaatctcaccctgtcgtccaggctgcagtgcggtggtacgatcttggctcactgcaacctctgctgcccaggttcaagtgattctcctggctcagcctcccgagtagctgggattacaggcacctgctactgtgctcagcaaatttttttatttttagtagagacagggtttcaccacattggccaggctggtcttgaactcctgacctcgtgatccacccacctcggcctcccaaagtgctgggattacaggcgtgagccaccgtgcttggccaaatttttttttttttttttttttagagtcttgttatgttacctaggctgcactcaaactccttggatcaagtgatcctcctgtctcagcctctcgagtagctgggactatagatgcacaccaccatgcccagcctaagaatgtcattttaattcctctattgcttttagctatatctgtttgaactattttttagtggttgctgtagagattacaatatgcatcttgaacttacccaatttattcagagttaatatttagataatagttcagagaaaacactgaaaccttgcaacagcatatatccatgtacgatcccagtcctgagtgccattgttgtcatatattacatctgcacactttacaaacccatcaaatacggtgttattagttctgctataagcagccatcttttaaagatattaagagaaaagtatgtacacatgttatttcatatttgccatttctgttgcttttagtttcttcttgtatctgagttgtcatttggtgtcatttccatttagcctaaagaacttccttcagaattttttgaatgcaggtctgctggggacaaactctctcatttttggtttatttgaaaatgcctgtattttgccttcatttttgaagtataacttcactgaatatagaattcttagtattttttttcttcagcatttgaaatatattattctaatactttgtttccacaggtttttttttttcctcccttccagcctttatttttgattcagggggtacatgggcaggtttgctacatgggtaaattgtgtatcgggggtttggtataccgattattttgccacctaggtaatgagcatagtacctgataggtagtttttcagtactcaccctcctcccatcccctaccctccagtagggccagtgtatatcgttccctttagcgtccatttgtactcaatgattagctcccacttgtaagtgaggacatgcggtatttggttttccgttcctgagttaatttgcttaggataatggcctccaactgcatccatattgctgcaaaggacatgatttcattctttttatggctgtgtagtattccatggtgtacacgtaccacattttctttatccagtctgctgctgatgggcatctaggctgatcctatctccttgttattgtgaatagtgctgtgatgaacatacatggacatgtgtcttgatagtagaatgatttatactacttcgttatatacccagtaatgggattgctcagttgaatggcacttctgttttgagttctttgagaaatctccaaacctctttccacagtggctgaactagtttccattcccaccagcagtggataaacattcccttttctcagcaatattgccggcatctgtaattttttgactttgtaatgatagccattctgacaggtgtgagatggtatctcattgcgattttgatttgcatttttctaactcatagtgttgagcattttttcatttgcttgttggccacatgtatatcttcttttgaaaagtgtctgtttatgtccgctgcctactttttaatgtttttttttctcttgtaaatttgtttaagttctttattgatgctggatattacacctttgtcagatgcacagtttgcaaatattttttcccattctgtaggtcgtctgtttactctgttgatagtttcctttggtatgcagaagctctttagtttaattaggtcccacttgtcaatttttgctttttgttggaattgcttttggagtctttgacataaaatctttgccagggcctatgtccagaagtgtttccacagtttcttgatgagaacttagccattaatcttatcattgcctctctgttcaggtcatttttctattgctactttcaggtattctcttcataattggctgtcagtatcattgtgatgtatctcaaagtgattttgtttactcattgagattcttaaattttaatgttttccaccaaatttaggaagttttcagccattatttctttaatttttttctgctcccatccccctccctttggcagttccaattacacttatgttgcattgcttcacattgttctacagatttctgagctcttgttcatttttcttcaatcttttaaactctctgttctttggacagggaaatttctattgatctgacttcaagttcattgattatttcttctgtctttcccaatctatttttgagtccatctagtgaaatttttatttcagttgctgaactttaaagctctagagtttcttttttaaaaattgtgttccagttctcaattaaaattatctatctcttcctagagactttaatttaaaaacagattttaattccttgaacatatatataatagctgacttgaagtctctgtctgctaaatctaacagatcgatccatttaaagtcagtttctaatggcttcctccctcagcacctcccccacaagtataggtcatacttttctgtctagtaatttttgaaaactcaatagtgtagataatacattgcagttactctgtttcgttcttttgagcattaaatttttatttttatttttttagttcaagtagacaattatcttgcttggtcttgaaatttgaaatctgttccacatacagtaggtagcagctgatatctgtaattagttcttactgctttccactgttgcttttataactaggctctgtgcctacataatttgaagatcagtcaagatttgggcagagttagggctcatcatctttgtggttccctcgcttctacagattcccctgtaatatccagctgcctttccagctttgggctttgtcctctgatacttcaaacaataaggaagtcttcagtatgctgatgcttcaattgcacacatttctcgcatgtattcaattataaaaagtagcaaactcaaatatctagttccatacatctctatctttcaaaagtaaatttctcttaggtctctgcctgcttcttcactggcctctctggggtccctcccccacttccatatgcataatttagttgtcaggcatgaatttggtaagaatttacactcagaatttggctctcactttttctgtgtgtttctcttgctgccagtatttcttctttaaatttcctattgctggccgggcgcggtggctcacacctgtaatcccagcactttgggaggctgaggcaggcagatcacaaggtcaggaaactgagatcatcctggctaacacggtgaaaccctgtctctaccaaaaatacaaaaaattagccaggcgtggcggcgtgcacctgtagtcccagctacttgggaggctgaggcaggaggacggcatgaacccgggaggcagagctgacagtgagccgagatcaagccactgcactccagcctgggtgacacagcgagactctgactcaaaaataaaataaaataaaataaaataaatttcctactgcttttctagccctaaactttgacctgggtaccttaagcccatacaaaggtgttttctgaagccacagctgtgggggttgggagaaccatcaggccagacatccaaaatttaacaattcttatttcttttacttctttctgttttgggtgctttctggtgttttaaaaatttatccaagttttaaaattgttacctatgggagggttcttgtaacacttagaaaatctaccattattagaaatctataatcaactttttacagattggaaataaggcttagaaagttacatagctaataagtcccagagtgagaattttcaataattatatctatctaaaactaaagcctgacttttccttgacatccttctgaaatttctctattacatattaaaaagaaccagagtctattgtgtcaataaatactttagtaaataacataaaagtagtattaaatgcttgttttccacctgcaaataaccagttaactgaaacttgatcttgtatcaatttgcgtttcagtaatgatgtgcttaggtgtgattatgacgttctattgaattaggctatagagaatggaaataaaaaattctttataaagttgttttcaataatatagtttagcttcctactttcatattttaagggtattaaaataattaattcatcttctgacaaccctctttaacacctaatccaaaataaatcaacaaaatagaaagaaaactaagcaataggtacccatttgtcttagaaatagaaaataccttctttttcatctgtccctgcagatcttcagtcacattagttaactcttccacttttgctacagcaactctcagctctaatttggcttgcctaaaaaataaagtaaattaataaacactgttttcatagaccactaagaataaaaaattagaatagaaatctgaatttggtaaaatcagttctaactcttgtttatctaaaatggatccatggaataaattttggaagattcctttattactaatgaagtgcatgtagaagatattaaagaggaaaaaatatagctgaatggcgaagggtatgaagtagaggtcatgaatgctgtacttgggtaaattatattatataccaaagtgattcaataagtttcttgaaaaagcactttatcatcttgatacattacctaacaagagctccagtgcactaagaagaatatacttatgtctataatatctttatagatggagatggagatatactgctgattggactttctatgaaaatgaacttaaacttcaataccttgatcattccatagacaccagaagtttgtattatgtaaacacaacataaattaaaacatttgttccaccataatacaatgtttattttcttcagagactgtattggcaacaaatgaaaaagataaatttttttgaacattctaacagaattaaataagtttcaatatcttcttaactcctcataggaaatgattttagaacaataatatgactttcttaaacagaaaaaatgatttttaatatcatcataattaagcattaagtgagtataaaaccctttgattatctaaagaacatacattttcaagaaaaaaatactgtagtgtaggaactgttccctatttcttaattacattttatgtatgtatctaaatgtaaatcatatttgtgctatagaacttacagaaattatttgatgcaaaattcacaagtaaatgttagttcatttccttttgactctttgtctttaaaactgcattacttatatagttataaatttcctacaatagaaaatacaaatctaataatagctgataatatctcaggtagttattagtgccagggactgttgtaaatgctttgcagtcatctcacttgacactcgataataactgtgaattaatactactattatatcaaactgaagtagaggagagcaaggttgatagaggtttactaatatgccctaggattcacaatacgtaataaaactagtatttaatgagtcccctatgacagactgcctaccctcacatggtcctaataatattttatatgatgaggcatttaagaaaatgttttgctttaaattaaccaagattataaaaaaaatcaaacaggccaggtgcggtggctcatgcctgtaatcccagcactttgggaggccgaggtgggaggatcacaaggtcaagagattgagcccatcctgaccaacatagtgaagccccatctctactaaaaatacaaaaattaggtgggtgtgatggcacgcgtgcctgtagtcccagctacttgggaggctgaggcaggagaatcgcttgaacctgggaggcagaggttgcagtgagccgagatcgtgccactgcactccagccaggtgacagagcaagactccatctcaaagaaaaaaaaaaaatcaaacaaaaataggtttttttcatttgcaaaatgattccctaaggacaaaataaaaaccacattattcatgtaaaatctctgcgtcaggctgagagataatttcaggagtatatctacaatctaaatcaacaaatgattctaccagttataaaatcctatatatttttaaaggaaaaacttaaggaataatatatttaagtagtaaggataaaactgagaaaactctgaaaaagcatagcaaccacactgatttggttttcttaccttcagaaaggataaaataattgcttgttctacttgtttcatgggattgctgaacaagtaaaaatagataatgtatattagagtgtcctgtaaactgtaagcaagataaggtcatagcatgatcaaggaaaaaaaaaaaaaaacctgttggagacacaggaagcaaggtacaatgtggagaacactacaggcagggacccaattctgtcactaactagtaatatgtcttaatacaattcacttgaccatgctgcacgtctcaaagacctcatgtccaaaaacagaggtggattaggcaatttgccaagaccaaaattctagaattagattctttccttatttcaatctaattggcctgagtctatttctaagttgtctttcaattgtgtattcctttttcattctttggcccaacctttagcttcattatcactcataagactattccagtagattccaaactcatctcttcactgatggtctcctcttttgttcattctttataatgtatcttatctgttaaaaaaattatctagtaataaaaactcctatttaacaatgattcctggattccacactttttggcataaagtctacactcctctacatataagtctacactcctctactggcatataaggccagtcaacatctagcctcaaagagtctcatctcttgccaattacccccatgtaatttatattccaagtataataaagtactcactcgctgttttctaaacacatccttgtttcttttttcacatgtttggctggactagtcttcttctttttctaaccaattccttaattttgacctagatcaaaaatctccccatcttcaagtcttcactaacttctccttggcaaaaaccctatatctcaatacttataatatataatactttatacattattaattgaacacactgtattgtaatcaatactatagagattctcctttgtggaactgtgagttcataaaaaatatacaatgtaagataattaaaagcaaggatcacatcttattaatttttaaaccttcaggagatagcatagtacctggggcataggagacaagtaaatcaatcataaatgaatgagagggcaaaaggaaaaggtggggggagggagaggggaggggaaggagtagtgggagggaggagagggagagggagggagagagggagagggaaagagagggagagagaaagagagggagagagagaaagagagagagaatgttacagtacaactatatcttgatattttacctagatcttgcacacccaatttaatattcatgtgtgaaaaattctagaaaaataattttatgaacaattattccaaatatatattatctcatattcctttgaaatgaaatctcctgctacataagtaaaaagaaaaaaaataggcactggacttagacctaatttggaagtcattataaaaaaaattctgaaaacattcatattatattatgttcactaaaccacaaatactatttttttggggggaaataagtagtggttttaaatatatttgtttattcccacactgttccatagaacagttagaaagtaagtaaatagttctttatatctacttttggcaggaagtgttgaaaaaaaatctaaaataaaaggcagaaggcctgtcttctagaactgactctaccaacacaaaaggtatgtgaactgggccaatcacttaacctctctgagtcttagtatctataaaatggagataaaaataattttcccatatagctcacagaattataaagttcaaataagttaatacatattaaagcatttaataaattttactgtagtttatacaatgcagctaccatcatcattttgccttttattagattaaattgtcaggaactgtgtagtaaagtattaatttacagctggactgggaaagctctggggatgcctgaatatctagccttgactcttagccagtatacgaacagtgggatttatgatgtgctgtttaaagtatgaatctcttcctgcagcctgcaagttgatttgtttactgataattttcaccaggcataactagatagccaggctaggctatgtgatcagtgtgccagaaaaaatgaccctgatgggaactcctgcctggagctctcctgaagccaagattcattgcacagatcttggtggctcaatgtggagacaaagcatgtctgtatataaataaaggccctagggtgcctatcctgaatgtgttctggacgctagatgcttgcctatgttctttttctggctgcacaatatcctttggcctttaaataaaagccttctgtaagtatgctctgtgcagtcttgtgagttcttttaaatattcaagcttttaaaatttttgaaggaactaacaaaaataattctaatattattttatgaagaaactcaataattatgtttatactatttacatgcaaatgttttagatatatgtctgcctgtgtatgtaattttataaaagtcaagaacagtttaacaaaaaaattttgatttaaaaaaacacaactagttaactattaacaatcttgatgtcataactaccaaaggattttatttttgcttcaaattaatattctaaaaagtacattactttattttcaggtatgcttgttaatccactttatattcctgggatttttcattaatgtattacttcatttcttatgatattaaacagatttgaatgacaacttttttttttttttttgagatggagtctcgctctgttgcccaggctggagtgcagtggtacgatcttggctcactgcaagctccgcctcctgggttcacgccattctcttgcctcagcctcctgagtagctgggactacaggcgcccaccaccacgcctggctaattttttgtatttttcagtagagacggggtttcaccgtgttagccaggacggtctcgatctgctgacctcatggtccgcctgcctcggcctcgcagactgctgggattacaggcatgagccaccacacccggccaacaactttttaaaaataaaactttgttaagcaaaatttaatcaagtataacataaaggataggatataatactagatttaaattataccatcaatttggacagaaattaaaatgctttaattatcaatacacttttttgagacttaacatcaagtacaatgagtctattttaagacaaatttttatgtttcttcctgcactgtcatacaaagagaatcctagaaatgtttatgccttttttgcatacagtgaaaaatggtaagattctcagatataaaagctagtttttgctgatttgatattcttaattttttcctctttaaaataaaaaaatgcacacgttaggtaatttaataaggacttttgtaattacccagtataataaagccaatcatttacacttaaaaactttagaaaatcctgaaacataattttagacaaagttctaaacttttaaaatcactactgcttttaggaaactgagtaagtaccaaaactggataaagttttatttcaaattttttcctcttcccaatctttactggcagtctaataatgaaacctattcaagacagaagggttccaaagaaattctaaaagcagtggatattataatccatacgctgagctatcaaaactttccaaaacagtggctcttcagtttttaaatacgttatttgtatattatttatacacacttgaagttaattcaaaattatacatagtttcaggtaattcaaaattctaatttctatgttagatacaatattctatgatactagtagtagtgtccatactttgtgtgtacgaaagtgagctttttgcaactaatatggataggctttttcacatcatatatggataggctcaatctgagacttactcattcaggacgtctgcaagcagtacttggtcatctctgtttttcagagtctctacaggggattctgatgtatattcactgtcttaaattttacaaaatacctacaagattgacaatttactcttttgtaaacgatgattacaagtctagtcttagagtcatgtaactttgggtaacactgacaaggtgcagaaaatattaattcataatctattattgatcagactattcaaatctcttatgcaacagacatgcttaaaacatgtttacttcatgcctgcaatgtttgaggtgctgcaataatgtggtacaaaacacacaaaggatttttctccttcatagatgatcatatctaccttacccaatttaaactttcagctcaatgtaattatagcgctatagtaatcttgaggagggccacaaagcaagcatatgttaagcaacaaaaaaattaaaataaaacattatgattctgagtatgcagcacatttacatttagctgggagaatattgaagtgagaggtatttaaagcaagaattggcagaggaattatatatctcacaagaagagacagagaaagctttaggaagaaacaagataagcacaagcataaaggtaggtaagtgtagggcttatttagggaagatgagaaataagactgtaaaggccatggggactacaatgtcaatgaccttaattgacagttaagttatctgtatcaatttaaaggcaaatgggaaactgtaccaataatggtatcggagctcagagctgcactttagaaatttaaacctgacatttgtgaaaaagaatagactagaatgatagttctgtctctctctgtaaccaatatgttataataaatgagcaagagggaggaaaagtctaaaccagagtgatgacaacaattctgagagagatggtgtagattttacaaacagaatttaagggattctatgcattcattctttgaacaaatatttattgaatgcttataacatgcccgacactgtgaatataatttggacatgttgagccttaagtgctggtggctcatcagttttttgtttgttttatctctatttcaggagtcctagagttattttactgagcacctacatgtactataccaagtactgtctattgagcacctacatgcaccatacgaagcactgtcttcagcactggtgatgcagtggtaaacaaggaagacaaagcccctgtctcataaagttcatattgtaatggagggagacaggcaacaagtatttcaataaatcaggtaattaaagaaagtgacaatgttacaaagaagatgatacagggaaataggaaagacatgggtcatcaggcacatctatggtagaaatatctgagctacgacctaaaggatgatgaggcaaactgaagaaaacttagggtaggagaattacaggtgaagataattaagaataaatgaaagaatatgagaaagacaaagaaatgacaattaagacggaacgtatcacagagaaaaaagtgtaagataaagtcagagaggaaggtagaggtcagatcacataagggccttctggatatactaggaattttggaatgtgttccaattgcaatgaaaatccactggagggtctgaagcaggtaaatgatgtgatatattgtgtggagaatgaattgcgatggaataagagtgaaagcaggtagaccagagaaaagggtactgcaaacaagagatggtggggtagaggtgatatggatgatgactagatttgtgatcatctgtacatagagccaacacgagcagatgtagagatgaagcaaaggagagcaagcaagcaaaaattctgaggtttgatgatggcattagctagtaagatagagagaccctctactccttcaatcatagccattctacttttataagtttaaattctgaggttccatgtataagatttctttttttaaaaaaggagtttactgtcaaaaaataaaaagtttgaaaaccactgacctagcaattcaattatggaactcaacaaagcaatcaaggtcagaggtgtatacttggaaaacattagggctgaaagtttaaattgggtagggtagatatgatcatctatgaaggagaaaaactgagtcacatggttagaaatctaagaaatgtatacttttcataggtaggataaggaaatgggggaagcaaaagaagcaaaaaacaaaacaaaacaaaacaaaaaaacaagcaacaaaagtcagagaagaaatcatggcataaacacaaaagtcctggtagagaaatgtttaagaaaggtagaaaaaatcatcagttaaggaaaatcaacaaccaaggagaatgagggaggcatttttaagtcataaaaggtaccagtaattcttgaggagaagaatagatggaggggggctgaatccaaactgaagaaaattccaaagagtgactataataaatacagattcttccaagcaacatcaaagaataggaagaagaaagtatctgaggagtcatcagggaggtctatacatctgaagtcttaaaagaaccatgcaaaagagaaactaagatttcaaaacaaaaagaatataaccgaaacatacaggagggaatagaaagaatttgggattgtacagttggcaagaaatgggggtacaatataatagaaagaggagaaagaaagaaatggttactctggtcctagaaattacagcagcaacaacaaaaggcagatttcccaggtctggggggtaaataatccactatttattacaatgttaataacaactcccaaatctattagcaggtaatttgtaagtactgtatatcctacctacagaggttggatactaaagtagaagggaggtgggcaaagacagtaagttatattatattgcaacactgcaaggaaggtaatttcattttcattatagcaatgaggaaactgaagtccatgcagttaaacaacctacccaagtcaatcaccagtaaatggctgttttagtctgagtatctgtgtccctgcaaaattcatatgttgaaatctcatataaatacaaccttcatataactctcaatgtaatgatattaccaggtggggccttttgggaggtgattaggtcatgatagcagtgccctcgaaaatgggattagtgccctcataagagaggcccaagggaggtttgtttgtcccttttacttcgtgaagacaaagagagaaggtgtcatgtataatcaggaaacagcccctcaccaaatcccaaatctgccattttcttaattttgaacttcacggcctccagactgtaataaatacatttctgttgtttatgagctattcagtatgtggcattttgttatagcagccccaatggattaagacaatggcagagccacaataaaaaactagagctgacttcaaagcctatgttttttaaatttcataccacacagaaccacatttttaaagacaggtgtacaaatgtagcgtatctgcaaaagaaagttataaacatcaattaaaatatattttgaaagaaaacagtcatctactcttagaggcaaaagttctgaacaatgatgttatgtatttgttttattcttgccagacccccaaacaagaaatgttaatactaattaactgtggctaaggttccactcttgaccagtgtgttctagaagtctaataatcttcttactgtctcttaaagattgagagaaaaagatatataaacattattgaataaaggtgacagtaatccctttaaataacattaaagtaaaacagtgtgaagaaatagaaaactgacagcaaagccctatttcttatcttaaaacctgttttccatgctcagaaaactagctgccaacacataaggaactgtctggcaattctatgactaagcacatctgctcagggccatttctcacatgggattgtttccaagacacactatgaatcaaaactagtgatccatgaattccagatttccatagcatttttataatagaagacacaatattatttaaattagaacatgaaacatctgagaaaaatctgttagctaaaataaaactattacctggcaaaagtacatgtcttttaaaaaataagatagtatataaaaattatcagcacacacatttttaaagaaaaaatatgcatttgtaaaaaagattaaaaatgaacacaatgaacatatacaaactgtgatttatataatttacctttccagatttaatatgatagagcaatactaagaattgcattcctatcacatcagctctaatgctcttcaatgaaaccacttatatataagtaattttgctagcatattttaaagatgtcctggattttatttcatatttaaatgtcgagagagcactaaacataaaaaatatttaaggctctagcacccagtcaaactttgagattactggtaataaaaacagatttaaaagtcaatacagcttaaatgctggatctataatgagaaacactaaaaatctttttaattcattgtgcaaagcttctattgattatattaaaatgatttttttttccaggtgtgttgttttggaaatcaaacttctaagtggtcacacatttctgtgtagctgaaggagataaaatataattttttaaaataatgacagttcaagaaaataattgtgcccttagaggtcaaagagcaaaggacacaaatagaaaatccacatgaataaattagccttgtctctccaataaagtgtaatttaattatttaattaactgactcactcactcaaaaagtatttttttgagcacctgccatatgtctagtactgtgctagatgatggcaagataaacatcaccagatcataatccacgccttccaggggctcaaagactagtgtagagagatggatttgtaaacacttaataaagtgttaaaaatgctgtgacatggtaagatatcagatctaaccaactgcatcttgcttctaacctccaaactctctttgtccattcctgggcataggctgaactagccttgggaaggaatttagtttatagtttaaatagcccttcccaaaagctagactgttattgtaaaatgaatgaaaggccactagccaccaagttaggataagaggggctggaattctaaatattaccagccatttagtctggaggtcgtaagatttgcaacttccccaattactcttgaagataacattactagtgtgaacctaaaattgtccttttaagatgtctttccaggtttttgcatttctgacagccggatggccccacctggacctgccaaccgtttctgtggcccctacccaggaactgactcagcattaagaggacagcttcgagtccctacaatttcatcctcgagccaaccaatcagcactcctgactcactggccccctacccgccaaattatccttaaaaactctgatccctgagtttttggggagactgatttgaataataataaaactctgctctcccacaaaaaaaaaaaagaaaaaaaaagaaaaaaatgttgtgacagatgtatgtgcagtctacagtcgaggcacacaggaagaaggcatgtttggtactacaggagactcaagctgagtaatctgtcaaactgaataatttggattatatcctataggcatttagtagccattgaaggagagtgacatgatcggacatattttagaaagatcactttgataacagtatgagaaaggaagatgggtacagtaagctaatttagaggttactactgcagctcagatgagaaagtgatgaagtgaaagatcagagagacatttataaggtagagttgggacagaaaagaatttatgatgtctcctagttttctgaatcaggaattggatggtacaattcacaaatatggagaaaagatctgagagataatgataagcttactttggagcctgctgcttttcaggtgcctctgagccatgtgggtagagataaccaggagaaccctgagctagaaaaatttaatgagatctcatcctcacagaaactgtcgaagctacgaaagtgtgcatgagatgaaatgggtcaaattaaaacaactttgaggctatcacattatacataaacttattataaagactgtttctaccttcagagcacagatgtacatgtttaagttctcaatgaatataaaataaattgattggacaaattataggctccttacatgaatataatatctatgtctgttaatgagataagtccttagtggctaagttattattattattttgagatggagtcttgctctgttgcccaggctggagtacaatggcacaatctcaggtcactgcaacctctgcctcctgggttcaagcaattctcctgtctcagtctcctgagtagctgggattacaggctcccatcaccatgcccggctaatttttgtatttttagaagagacggggtttcaccatgttggccaggttggtctcaaactcctgacctcaggtgatccacccgccttggcctccgaaagtgctgagattacaggcatgagctaccgcacctggccagctaaaattatttttaacaaatattctgatgatgccactctgatgagaagttaataaggaccccatgcaaatgctttacttagtcttttttgtttgtttgtttgagacggattttcactcttgttgcccaggctggagtgcaatggcacgatctcggctcaccgcaacctccacctcccaggttcaagtgattctcctgcctcagcttccctagtagctgggattataggcatatgccaccacgtccggctaattttgtatttttagtagagatggggtttctccatgttggtcaggctggtctcaaactcccgacctcaggtgatccgcccgcctcagcctcccaaagtgctaggattacaggcgtgagccactgcgcccggccactacttagtctttatagtacatccttttaaaagataacattggttattcctagaaagatataataaatgacaatctttcccttcgaagactttacaaggcaggcataaaatctgagcacatgagagttggaaaataattatcatcataactcagttggatatatattataaataaatgtataagacaaaaaaagcacctctggaaaaacagtataaatctcagtttaaatgaataaatactgagtaggttcacaagaataaaaaagtaaaaatctggtagaatgaatgagagaagtctttctggagaaggcaagttttagctaggtttagaaaattataaattttctgagaaacagaatgatctaaggcaaaaaggaagttaccaaaagttgttctgcgggaaacagcaatatgactatttttctgtataactggaggtttgaggaggatcaggtgaatgaaggttcttaagaaaataggctgaaaagttttatctactatgacaaggtatcaccaaaaactctcaaaatgaaatatgattaaagctttaattataagttcacatgattttaacttttttgcaccacactatcagacaacaaatgaaactaatatgtttcagtataagtacaaacttaaacaactctagtacttaaggagtttctaatttagttattcttggcatggctatatagagcatctcaaaacctaaattctggtaatgtcaatatgcccatcattcagaatctgtcatacttgaaagcaacactctcttccgtaaaagaagcatctgtttatccttatgttccttcaaatctgtggcaggaaaagcaagtatagttttatgtatacaactctgaactgcttaatgttaagctatggaatactgtcagtaaatattatggcaaagttgttcatggacaattaaacacttaagacgttttaggctttggaaaactgcaactagttttatcaatctctaaactcaatttataatccttaggccctaatgtccacactaaatgaatcttccaggcagatgtcaaaaatcaaagtatctactcatcatacttttttcccctgcaatcaactctgctacttgacttcctcactgctgtgaatactgtcagagagccaggcttagaagctcactagattagcagttacaagatgtgagttctaatttggcttttccatgaatttgttgtgcaactctggacaagacaaatagtttctaagcctttggttcactttgagttttctataaaattaggaagtcaaactagatgaacattaagataccttctagcaataaaatttcatgattcttcccctgtcctttagctcaatattacgaagttctgcccatttttcctatatagatttttttatatgcatttttattctctatttccattactataatatgattgcaggtctttatgaaccagtttccttactcatccttccaggatctctaccttctaatttatcctacatatgccaaaaatcttatatcctttttttcctcccactcttttcttaaccttgaatgtaaagttgaatttttacactattcattccatgacctattatcattatcagctgtaaaagatattctcatttgtttatttttgtttttttgctcattcccaatccctttctcattctcctccatttcataagttcatactaaaatgtgatatatcctcagatatacacatttactggtaaaatatatattgttattacaagcatatgttttatgctatagatccatatattttactttttaaatataaacactgttttctagttctacccatgttgctctaactacatctttacatgtaaatatgtgtttctaaatgatgcacagtattccttccacaggatgtaattatcacattttactgttcattcccttagtgacaaatacctaggttgccttcaattctctacttccacaaatagcctcattccacagagacaatcattaacttgaagtaaggatatatcatttctgggaatggaactttattctcttgtaatacacacacacatacactacatatatatgtaacagatatataatttttactacatattttgaatatatattgatatatccatatacatatatcgatgatcaatacacactattgtttaaaagatttaaactgtatcacactgtaattttttggcctctttattacactccacatttttacattgattgctgagtgtgaagtagtatcatgtttttacttgcattttcctgattgctgtaacttttgaaatgcttattcatatcgtttgcctaattttcgatgagttaattattctcattgatacttaatcagttaatgtgtccttaacactaatctgttgtgttacaatacacgcattgtaaatgtcttctcactgactatgagttgtcttttcatttgacttatattgtttttgtaacagaagcctaatatcttaacatatacaagtaaagaaatcttttcctttttggcttgtatttaaatcttttgtttttttcatgacaggctaattttaatttttgtagagatggggtttcaccatgttggccaggctggtctcgaactcctgaccttaggtgatctgtccgcctcagcctcccaaagtgctgggattacaggcataagccactgtgcccagcctaaatctcgattaagaaatatttctctaaggagaggaagcagagcaagatggctgagtagaactctccaacaaccattcccctgcaaaaataacaaattgaatgaccacccacataagaaagcaccttcataagaaccaaaaaatcatgtgagtgatcacaatacctggtttgaacataatatcaaggaaagaggtaccgatgagtgtaggaaagacagtttttcattacccatacaaactgcccccagccccaggcagtgcagagtggacagataatttgtgtgctagggggagggagagtgaagtaagtgttgaactttgcattagaattcagtgctgccctgtcacagtggaacacaacataggctagaattccaccagcacccatggagggagcatttagaccagccccaggccagagaagaattcaccgtcccagtgggagaaaaccaagtctttgctgccttcaccaccactgactaaagtagcctgggcctggaataaatttaagtggcagtcaggccacaaggactgcagtcctaaggcaagccctggtgctgcactggtctcagaggcagtgcacttagggtacaatacagtgtgaccagcagtggcagccaaaggattgcctgtgtcatcccttcccaaactccaggcagtactgctccaaagagactctttctgctcagggaaaggggaagaaagagtatagaggactgtgtcttgcaacttgaggacgagctcagccacagtaaaggcaccaagcagatttctgaagtcccagattctagatttttgcacctggatgcgtttctagactcactctgtgctagaagagaatccactcctctgatgggatggaccccatcctagcagaattcatgccctgctaactgaagtggtcctgggccttgaataaacatcaggcagtggtggctgcaggccttgggttagccccggtattgtactggtctgaagggattcgggtgtgactctgtgtagtgctagctgtggtagccatgagagtgggcacgtcacctctccccaactccagacagcacagtgtacagagagactccttctgactggggaaggagtaagagactttgcctggttacccagggaattatccctcatcttaccgaagtctagcaagtctgtgtatgtaggaggatctaagagctgcagcattcctaggcttaggaatctaagcctaggaatggttctgaaatggcttctgcaatgttctgaaatggctgcaatgttctgaaatggctgcaataattgcaggcttaggccaaaacactcaatctcttttggattcgtggaaagcccactctagaaggaagaatacaaacaagccaagactgcaaaaattataatacctaactcttcattgctcagataccgatgagcatccacaagcacgaagaacatccagaaaaacatgacttatcagatgaactaaataaggcaccagtgtgaccaatcctagagtgacggagatatgtgacatttcacacaaggaattcaaagtattaattgctgttttggggaagctcaacaaatttcaagacaacagaaggaattcagaatcccatcagaaatttgacaaagattgaaataattttttaaaagtcatgtagaaattctggagttgaaaaatcccattgaaaaactgacaaatgcatcactctctcaaaagcagaactgatcaatcagaagaatccatgagcttggagaaaggctatatgaaaatacacactcagaggtgaaaaaaaagaatgaaacatgcctacaagatctttaaaacagtcttaaaggggcaaatctaagagttactggtctcaaagaggatgtactaagagagatgagagtagaaagtttattcaaagacataataacagagaactttccaaacccacagaaagatatgactatccaggtacaagaaggtcaaagaacacccagcagattcaagacaaataagactacttcaggacatacaataatcaaagtctcaaaggtcaaggataaaggatcttaaaagcagcaagagaagagaagcaaataatatgtaaaagcaaaattgtctttcaaacatagaggagaaatgaaaactttcacagaaaaaaaaaagcttatgaattttgtcaacaccgaacctgtcttacaagaaatgttaaagggagttcttcaattcaaaagaaaaggatgtttattagtaacaagaaatcatctgaagatataaaactcactggcaatagtaagtacacagacaaatacagaatattctaactctgtttagactcctttaattgtaatggtggtgtataaaccactaatacctttcatcagaagactagaagacagacttaccaaaaattataaatactacaacttttgaagagatagacaatataaaatatatgtaaatagagacaacaaatcaaaaagcaggggagatgaagttaaagttggagttttaaattctctttgcttatttttctttataatcagagttaagttgtcatcagtttaaaacaattggtcatagtatttgcaagcctcatggtaaccacaaaaacaaaaacctataatagatacaaaaaaacctgaaaagccaagaaattaaaatatactacaagagaaagtcacttttacacaaaggaagacagaaaggaaggaagagaggaccaacaatacaaccccagaaaaaaagtaacaaaatggcagtagtgagtcctttcctattactaataacattaaatgtaactggactaaattctccaataaaaaaaagagtagctgaatggataaaaaataagacctaatcatatgctgcctacgagaaactcatttcatctataaagacacccaaagactgaaaatacaggaatggaaaaagacagtccatgcaaacagaaaccccaaaagagcaagagtagctatacttacaccagataaaatagatttcaagacaaaaattgtaaagagagtcaaaaatgttattatataatgataaaggggtcaatcccacaagaggatataagaattgtagatatatatgtactcaatgctggaacatccagataatataaagcaaatattagaactaaagataaagttagacaccaataaaataacagctgagaacttcaacacccctctttcagaattggacagataatctacatagaataccaacaaagaaacatcagattaaatttgtactatagactacattgacctaataaacatttacagaatatttcatccaacaggtgaaaaatatatgtttttcttctcagtatattaaacagtctcaaggacagaacatatattaggccataaaacaagtccccaaaattcaaacaagctgaaatcatataaagtatcttttctgactacaaaggaataaaactaaaattcagtaacaagaggaacttgaaaaccacacaaacaaggaaattaaacaatacgctcctaaatgaccattgggtcaattaaccaatttagaaggaaatttaaaaatttgttgagacaaataaaaatagaaacacaatgtatcacaacctatagatacagcaaaagcagtactaaaagtgaagtttatagcaatagatacctccatcaaaaagtagaaaaacttcaaataaacaacctaaggatatatcttaaagaactggaaaagcaagagaaaaccaaactcaacattagtataagaaataataaagagcagagcagaaataaataaaattcagactaaaaaatacaaaagataagtgaaaaaaagttgtttttttaagacaaacaaaatcaataaacctttagccaatccaaaaaaaaatacagaagactcaggtaaataaaatgagatgaaggagatattacaactgaaaccacaaaaattcaaaatatcataagaaactattatgagcaactatatgccaataaattagaaaatctagaagaaatgaataaattcctagaaacatccaacctaccaagatttaaccatgaagaaatacaaaacttgaatagaccaataacaaacaaggagatagaagtggcaataaaaaaatctcccatcaaagaaaagactaggacttgatgtcttcattgctggattctgttgaacatttaaagaagaaataataccaatcctactctaactattccaaaaaattgtgaaaggaatacttccaaacttattctatgaagtcagtatcaccctgctaccaaaaccagacaaagacacaacaaaataaggaaagctataggccaacatctctgatgaacacagatgcaaaaatcctcaacaaaatattaggaaactcaattcaacaacacattaaagagatcattcttcatgatcaagtgggattcatcccagggatgcatggatggttcaacatgtgaaaatcaataaatgtgatgtatcaacaaaagacaaaaaccatatgataatttcaattgatgctgaaaaagtatttgataaaattcaacatctctttgtgataaaaactctaaagaaaacctgggtataggagaaacatatctcaacaaagtaaaagtcatgtatgacaaacccacgggtaatatcatactgaatggggaaaaactgaaagcctttctgctaatatctggaacaagacaaggatacctactttcaccactgttattcaacacagtatgaggagtcctagccaaaacagtcagacaagggaaagaaatgaagggagcccaaattggaaaggaagaagtcaaattatccttgtttgcagatgacatgatcttatatttagaaaaacctaaagattcaaccaacaaaactattagattggataaattaagttgccacatacaagatcaacgaacaaaaatcagtattatttccatatgccaactgaacagtctgaaaaaaaaaacaagaaagtaatcccatttacaatagctacaaataaaacaaaatactcaggaacaaaaaaccaaagaagtaaaataactctaaaagaaaactataaaactctgatgaaagaaattgaagatgacacaaaacaatggaaagatattccatgttcatgaatcagaagaatcaacattgttaaaatatccatagtacccaaagcaatcaaatctatagattaaatgcaatcaaaataccaatgacattctttacagaaatagaaaaaaaatcctaaaatttaaagggaaccaaacaagacacagaatagccaaagcaatcctgagcaaagagaacaaagctagaggcatcacattaactgacttcaaattatactacaaatgtatagtaaccaaaacagaatggtactggcataaaaacagacacagatgaactgaacagagaacccagaaataaatcaatgcatttatagtcaacgcattttcaacccctatctcttgccatataccaaaatcaaatcaaactgtatcaaagactaaatctaagacctgaaactatgaaactactagaagaaaatgttggggaaacactccagacattcatctgggtaaagatttcttgaggaggacttcaaaagtacaggcaaccaaagcaaaaatgtacatatgggatcgtatcaagctaaaaagcttctggacagcaaaggaaacaataagtaaataaaaaaacccacagaatggaagaaaatatttgtaaactacccactggacaagggattaataaccagaattggaatatataaggagctaaaacaactcgagaggaagaaaaagaacaaataatgggcaaaatacctgaatagtaattttgcaaaagaagacatacaaataaatggacaataggtatatgaaaaaatgctcagatgatttgtgggttccccattcgtggattcaaccaattgcagattgaaaatattttttaaaacaataaaaaataaaaatttttaaacaatacagtatataatctatttgcatttacattatactaggtattataagttatcagattatttaaaatatatgggaagatgtgcataggctatatacaaatactttgtcattttatataaaggacttgaacatctgtgtatttaaaggtctgactgtatatcacagttatctcctaataatcttgatttcagtttcttcccatcctaacagatcatatacacaagaagatattggcagaagcttaacaaaaggaaggcaaaaaaacacccatggggaaaattatagcatcatcagctcccctgaagaaaaataattaacaatgaaataatgaaactcatttttgaaaatacctaagtttttttcggagttgttcgattatcacactttgttcagttactgttttcagaaactgttggttagtctgccacaagaaaaaaaaagaatcagtattagaatatttaataactgtatctttaaagatgacacatcagacatacaagtagaaaaaaagtttagtgagatttatgataaagattagattttttgagggtaaaacataaccttggccttctttccttgcctttactacttcattggatacctgcttcacttgaaactacctacacctgcattcctgtcttatggctttctttggctatctgaatctcttttgctcatctatccacctgggcataaagctataagtgttatagaactaatgttccaccctgttctgagcagcctgacatgtctgaagggaactggtatataaaaaacccaaactcccttcttgcatgggtgaaataattctgaggcttgtgttctacactgtctttcagaattcattaagttttagttactcacagtgttaacttgcttaattttaaaaagccctttattggctgtcttctcttctcttgataccacttccccaccttcttactggtgctccctggtattacctactaaataaatgacacgttttggaactttttcctgaaggtcagcttctggagaaatccacagtaagatatgaagtagtcttctagatgtagaaaaacttttcctaagggaattgattttcttccataactgctggttttatccatgatgatacaaattccttatcccttttctttatatattatggttgctcccgattgatcttaatagttttgatttaatcctgtcccaacataccatgcttaaatttctccaactaaagtccctgagatagctttcattgtgcttctctcatgctctgagctcactgacttcatatttttaacatactatcgtattttcctctgcccaggatgtcctcattctgtctgcattcattcctcaataccatgtgtggtttactcattctcaggtagaattaactgtttcctttctgtactttgataaaacttaatacatgcctttacagtgcacattatatttaaatattaaagtgtaggtattcctgactaaaatatgagcctttttaaaggatcagcttttcccagaactcctagtgcctggcacatgattgagtacatcacaggcacaactagtgttttattatatatactgccttggcactagcataattaatgcttgtgtttttgaccatttgggaacacctcaaagatagaattacatagagcaattaacagaagtataagctaaaattctgcattttaagaatctagtgctggaaaccaaggtgcttaacttgctagcaagcctagtaagagctccgcaactgcatctgaatatggcattgttgttctatatttatgaccataaagaaaattatgtactatattaatattttagaattaggagactcgagaaggtgcagggaagcatccttttcaaccatcatctatttagcacctttttcactgattatttcatatgtcagcctgttttaccacggagacagagattttatggttgatgcatttttgcaacttagagaacctatactttcatgcaggatagttagtatgcaattaaatatttttgagtaaattatagagatgagcaaatcttaaaaaacatttcagtaaagcaaacctatgggaaatgtaaaattataatctatctacagcataataaatagaaatatatacttttatgtaccattcatgtcagagcatatctattgcatattactaatttgcattggtaaagaaagatatttatttgtatcaatttgtagtaagaatacttacatgagttatgcacttttaaaacatgtttaagtgtacaatacgttattgctgactacaggtacaatattgcacagatctctagaggttattcatcttgtttgaccgaaacttcatgtgtgttgattagtaagtccccatttcttctcaccaaaggccctggaagtcaccattccaatctctgtttctataaatctgtctactatagatacttcgtataagtaaaatcatacagtgtttagtctttctgtgactggcttatttcatttaatgctctcaaagtttattcatgttatcacatattgcataatttccttctttttaaaggctgaatagcattccactgtatgtttatacattttaatccactcctctttgatggacatctaaggttgttttcgtatcttggctaatgtgaatatgctgcaataagcacaggaatgctaatatctcttcaagatcttaatttcaatacgttgggataaatattcagaagtgggatttctggatcatatggtagttatatttttatttttttgaggaaactctatactgtgttccatggcagatgcaccgttttgcaatcccaccaaaaatgttcaaggtttccaatttttccacatcctcttcaacacgtgttgtcttttttgttttgataataatccctctgacacgtgtgaggtgatacatcattgtagttttagtatttatgtttccctaatgtttagtgacatcgagcattgggcatttcttcacatacccattgccttggaaaaatacctatttaagtacttagctcatttaaaaatcaacttattaggtttttttgtgtgtcttttgttttttactgctgagttatagaaattccttaaatactttggagattattcccttattggatatacggtctgcaaatattttgtcccattccataggttgccttttcactctgctggtttcgtttgctgtgcaaaaactttttggtttgatgcagtcccacttgattacttttttcctgctgtctgtacttttggtgtcatatccatgaaatcgttgccaagaccgatgccatggagattttcccctaggttttcttctaagaactttataagtaagaggtgttagatttaagtctttaatccattttgggttgatatttgtgtgttgtgtaagataagagtccaaaatcatgttttgaatacgaatatctagatttcccaactccatttttaattccgttattgtgttctttaggtccataatttgtgtgctactttttaatattttttctctgttgcaactctcactttgttcatacattgttcttttaactgtggtgagcatcttcatgagagttatttttaattccctatcaggtaattcataacttcttttcattaggattggtttctggagatttatcttatttctttgtatggaacatctttagctggttcttcatttttccttgactttgtgctcacgtccgtacattagagaaagcaggcacctctcccagtcttcacagattagtgtcatacaagagaagacccccacaaatcagctggccagagattcagcaggcctctaccaactctttccctccccagggagatgctggcagctgtggctttgtctgcttgctctgtgatgagctggggggtagggaactatagcatgtatcagcccaatctgctgtctctgttcttccctaggtgtctagaccatgctggacctattagagcttcgtgagacagatgctatttctctgggctgccctagagaagctgcagtgctggatcaacttttcccctccctaggggaaagttgagaactgaattttcatctacttactctgtgctgagaagagcacaggaccaatgccaactatcagtccaaaccaatgcctccattctcccttggttggccagactatgctggatctgtgagctccgagactggcaagatagaggccagtattctggggaccaccctcagaaaatttggggtgatgaatgcacatacctaatcccttccctcccctgggtgaagctgggagctaaggggtctttttttgatcacatggcacggcactggggacagggtgcctagcaagagagggtctcaaatctccctgctagctttggtgagtctggttttccaatcccccaggaagtgagaacatttccattcatttctgatttattgcaaaggaaatttgtccatgaattgttgctgaattggtgtatctgtggggagaaggagtgtccaggatgtcctactctgccatgttagtcaaattatattgaaagacagtttatttactcactgcatactcatcaatttattctacatctataaaaatctattcatttaatgagtttattcgtgtaatcagaaaattttttgttggaaacttcttgatttttaaagggcacttttcttcaagtttgatcttgactcatacttgcccccataactatgttctgaatgctctttgaactgtacaagatcttatcactttgcttgctccctttatacttatcagtcttgtttgctattcattatatacattaagaacaacttaaattttaaaatttctttcaaccatttacttttatcttaaccacctatatagtcttttctatatttttataaaactctcttttattcatcatgccatttctttatcagttttctcgtatccagtttattcttagctctgacctggaaccatgaatacttctgccttagaaatttttaacatattcccttggaatatacaacatccttttcccatgactttctttcatcaaaatcataataaaataggggctctgtgatatgatatatcaaagaatgatacaattccaattctaggagacatattgaagaagtaatgaataattatgatgctaggttaaagtactaattccatatagaaatatattaaattaaaaaatgcctttcttaattatagaaatcagtaaccattttgttctggagtactagtattttaaaactctaagaagtataatatagtatcaaaaactgtatgtaattagacacttcaaatgttaacagaataggtacagattggtttaataattttttacatggttaaaaaagaaaaatttttaaagtagaataaaattggatacttacttttgatagcacaaatccattgttatacaaagacatttttattaggtactaacaagaattagcagagtaactaagcaagaatgaagaagggaaagagagaggaattacctgaagtgtcataattctattactcaacaatgaggtaaaaataacattccaagaaagtaaagaaaacaaaagtgagagaataagaaggtaaagagcagaactggaaagactaattctatttattttaggagaaacttatagggaaatttaggagtaccataccaacacatggtccttagtttcctaaaactttttaggcaatgggctattaattcattaaacaattacactattcttattaaatacctggcagtgtgtcaggtgaaataaaaaaaattaagcatgtactctactcttgaggaactcactgtctagattagtctaaggagaccttactaagaatcctaagaggatttccagattaagatatatttcagagagatgttagatctccaaaaggtactgtaaactgtgtcatgctattgaatgagaaagcaaaagcaaaagaaaaaacagtattatctaatttcgtgcagcatgcttattgttgatttatattaacataaataaatatgattatttatagggacaatttctagtttatataaataagtatacttaccacttccatgttctcattagtaacatgaagttgtttggtcagttgttgaaaatcaaatagctgatcctacagtgggaaggtaaggggagtatataaatagcattttgttgtttataacccatatttaaaattaaactaaaatcaagtctaaaatcattatgcctaagtttagataaaattagtagtgtttcttattactattgtgtgaattagtagttgaaaaactaagaaattttttaaatgattaaaaaattaaagtggcaatgctgaaattaatgtggctgtttattttatgtcaaataattatttctagaaatcatttattaaatattattttaaaacttgaagaaagagatcataaaaaattataagtgattagaaattctaaatgctagagagaccttgtccaatattggaacgtcactttcaaacctactcaaaacctataatacaaaccatggcacaggagttactgcccaccttttttaaaaacattctcatgccccacattttaaaaattgtttgattagctgttatgattctattaaacattatttgtacagacgacacaaagttgggagaggctgtaaatatactgaaagacagaattaaatagataaccagggaaaaaagaatgaagtgctatttgtaaagtcttgtataaggacccatcaaactatgtagctatagtaaaagaatgatattattcaggtgaaaacaaaacaaaaacccaaccttgtgggcttagttgattgacctaaatgaggaaacagtcctcaaagaacttaatatgaaaaatggtttttaaatctcagaggtaaaagtccaacaaatcagattgattacatgtggactttttttcaagccagggcatgtaaagaaaaatcattttgtaaactgtaaagcatcacataagtatttttacaatttctttaggtagatatttctaattataattacaataataggaatattcattaaccagaatttgaaaagtctgtaaatgagagctgaagagaggtatgaaaaccaacttatttaaagagcttcctctcaaaatacatagaaaagaggtcagaattagaattcctccatagtgctcaatgcacctagcaataaaagaaccaacagaagaataaaagaggtagatttccaaatggaatagatggccttgtgagataatgagttcttgtcaatagacgtgtaaagcaaaagctaaagctagatgtccactttgaaagagtgtagaatgattcttgctttgggtagaaaaaagtcttttaataaccattaagataccttcctgttgtaaaattctattctgattaatttatgatagacaaaattgacacctattttagtaacaggtcacatttaagggtattaacatttgattttacatagtgtttccactgtatttgagcaggtttcttcactggccataaactaataaacaattttgttttgttttgttttaaaagtcaggtaggaaatcaagcaaataaaaactttgaaggtttatttatacaaaataatgttaaagttgctctttagcactaaattcagctttcattgctgacaacattatagaaccaaatgatcactgtccagttctctaattagtttacctgttcaatagtgtaaccatcaaagatctatatattattaacataaataataaagtgattagaaattctaaatgctatagggtagagtcttaagcgttcccctctaaaacagtttcttcagagtgcaatttcttattgatatacaagaaaatgatgaaatccaagattaccttttgtttttgactttcaaatacatgaatctgggcctcagtcatatgttcctggtaaagcttgtgtagtctgtccaactcctgagaaacagtctgccagagttccacagcctgagttttttcctattaaaaaagtttgataactcattaaattatcagcaggctatttattgtatagtacaaatggatcattttcttttatagaataagttcttataaagtcataaaataaaatagaactgtgtaaagatggtattatagttatatttttgatatgaagttttattattaataatttagagagtaaacttgaagacataaagttccttattttgaaattgtggttttactcagatttagctaaaattaaaatccttaacagagatgtagatttaaaccatgttctttgttccacaagaaagtataagccctagaaactgatgaagaagaaaactgcctcctggtaaagtacaatatttttttcctgatcataaaagtaataaattttcattgtggaaaattaggaaaatacagagaaaaacaggagaaaatcagaatcacctataattttactacctgataataaatattgctaatatctagataaatcatctttttaaatgttgatgcattcatgtttataaatgtgattctgggtgagaattttgtaattattttaacaaaattagggacaatatagtgggctatttttacttgccattttataatgattttataattataattttctcaggtcactattgtttgcatacagtattatctaagtgtggtacagaaacttttaaactttgaaaggtcctagaagtcaaatttatcttcagaataatatgttaacatttttcgcctttttactctcatcctctcacaaatgtacagtgaagttttctaaagtttatatgatgtgatgccatccttgctctaagggctaatggactacatgcttatgctcctactttttttttaagtctcagttttaatttgtaatacaataaatactgatagatatgtaacccacaaaaaacataaggcaccttggagtacactgaggtataccatgcattcagaaaatgaacaaattgtacatttttataaagcaagtgcgcttatgtaaccagcacccagttcaagagaaagaacattaccatcacctagaagctggacgaccctcttgtgatctcttccagttactatactcttctcctaaataaccatttcctcgtgttcctaacaccatagattagttttgtctaaaacttaaaaaaaaaaacaaaaactgtaggctaattaaaaattttaaaagcggttttaaaatttgtagataaacacagaatatggagccagaagatatgggtgtgatctctaattcctggctaaatagtcctggataattcacttcatttccttaagactcaagttttcttttcagtaaaatggtcgtaaaaatgcctcatacctcaaaatgtcccactgtttctccagacctgtctgacgacaaaaatcacctagactagtagttacacaacccagattctcctagagcagtggttcttaaaggatcagcatcatcagcaacacctcagaactgttagagatgtaaattattgagctctttcccagacttcttgaatcagaaactggggtggtgggggggtggggaggcacagcagaaatccatgtttcaaaaagccctcaagtgattatgatgtacactatataatttttaaaaatggtacaacttactatttggacaaactacaatttaactgattccatatttaagatttttaaactatgtcaaatgtttcattacgataaatattataatgaatatatttattcaaaaatttttatattcagttctttagaacaaattcataaaatctatgtggtgtcatcatctaattactggatcaaataatgcaaacatttctaaggctcttcttccaaactgacttctagaaagatttctacaaatcatactgtaacagaaaaaatattttaaactgaaaatattaagctaggtacttagcattgtgctattgctattggctcctaaagcaacatatatacactacacagcaccttttgtacataattttaattcttatttgtgagtcttgctgttcaataatgataataatgataaataggcaaatttattaacgtacatatgtgctagacatataagcctaaattaatttctatttaatcccatgaaatcaattataaatctttcctagtctagaacaaacagcatgctttcctcattatttctttctttcatcatatttaaaaattctttccattcatacattaaaaaaaattagtgttaaatacatgttccttatcaagctaaatatagcctttctgacttacctaaaatatcactttcataattatagaattttaaaaccaaattttcaggaaataaaaccgaattttcagataattatcaaatcaaaattgtaatttagaatttgtagcccccatttataaatgaggaaactgaggcacaagagtttttttctatgatcacacacctggaaagtagaagaatggggatttaaacccatacaagatatgaaacatttgggatataacactgtaaatttaaatacaattcccttatgaataaaattcacaaaaaattagttgaaaaacaggatatatttaacatagctgctcaaagattctaattactatgagagaaaaagaaaaagtataattctagaagaaatataatgttagaaaaatatagtactcttaatattctgaaaacaatatcagaaaaaagaacactgaaaaatacaaatttagagaaataatggattttttcctttaaaaattttcattgacattaaaatattctctctacaaagaacttaaacaaatttacaagaaaaaaacaaacccatcaagaagtgggcaaaggaaatgaacagacacttctcaaaagaagatatttatgcaggcaacaaacatatgaaaaaaagctcattattactggtcattagaggaatgcaaatcaaaatgacaatagaataccatctcatgccagttagaatggtgatcattaaaaagtcaggaaacaacaggtgctggagaggacgtggagaaataggaacacttttacactgttggtgggagtgtaaattagctcaaccattgtggaagacagagtggcaattcttcagggatctagaactagaaataccatttgatccagcaatcccattactgggtatatacccaaaggattataaatcattctcctataaagacacatgcacatgtatgtttattgcagtactattcacaatagcaaagacttggaaccaacccaaatgtccatcaatgataaactggataaagaaaatgtggcacatatacaccatggaatactatgcagccataaaaaaggatgagatcatgtccttttcagggacatggatgaagctggaaactatcattctcagcaaactaacacaggaacagaaaaccaaacactgcatgttctcactcataagtgggagttaaacaatgagaacacatggacacagggaggggaacatcacacaccagggcctgttgtggggttgagggctaggggagggatagcattaggagaaatacctaacatagatgatgggttgatgggtgcagcaaaccaccatggcatgtgatacctatataacaaacctgcacgttctgcacatgtatcctagaacttaaagtataattaaaaaaaaaaaaaagaaaaagaaaaaaaagaaagaaaaaatattctcataagaaaaaaactcacgtcaaaatctttatgattttaattaaacacatttgtaacaaccagtgagggtatttggcaagtacgtttctaacagtgagggtatttattacaagtgttgctacctgtaacgattcttataaactgtaaaaaatcataatgttacaattttattattttgttatccataaataatgattaacatgaatttttaaaaaggtatgttaattcagaatataatttttaaaaatacatgtcactcacttgattggctagctgcaattgttcttgaaggtttctgactgtttcatcatctgcatatatgtcagttcctacctctgtgcccaggggaaaggcctccaattttttttcaacagcatcttttaattcactgtgcaacctttgaaacaaatagttaacatgatagcctcaagtcattttcgtaacagtaattactgtttcgaggtcaattaaacatttgggtcaacaataactctttaaacaaaatcatttttaagtagacttcaaataaaaaattagaagtgtttaattaccattaaatactgtgctataagaatcaaaagattatataacaatttcaatgcattaaatcgatcacaattaactgaagcatgattcagtttgtcctagagaggtttcaatttttcaaaaattttcaaaagagtaaaattcagatattatctcttattaaatgataaaataagccattcagaaaaattctaaaatatctatgtatatctagtcaattaaatgaaaattatatattaaatcctgtagaattatttgctattttcttcagcgtgtttcaccaaactcactggacttcttactaattccagttaacaagcaaagagaagaaaatggtcgctggctataaaaccaagacatcagaagctttatttttcagcacatccttatataagatcaacaataatactgaaaggcttaaaattgactttaatcttaacattaaggtaaattacagatatttcatgccttaactacaaaaaaaagcaaggaaggtacaacttaaaagaatgattgttttaatttaaaataatacatacttaagagaaaaaaagtacattttcagaaaacactcttatttcatataatcataagcagaaaatatttatagtaaatacattacaaagtgaaaataacaaaataaactacatccatctacctaaaacatttagaggtgaatgatttactaatattacaaatctcctttgaaacaagaaaacttaaatcttgatgtcaaaacatatttattgaaaacaaaattcatcaaatacaataaaactgagaaggtaaacactttagaaacaaaaaaattaattactctgaagaaaggacagagcttgaaaattattctctaattaaaaaacttacaagtattggttaagacagtttttatttttaaatatctaacagtgtttttaaaaacttttatttttcctatatgaaatgtttacctaatagagaaaatgatcagtatagaaatataacaagttttagaaaagataccccaagtcctatgaaaaaaaccattattaattctgtaatatattttctagcagaatttttactttccattaaaaatagaccaatgacatactgtattgctaatactataatctgtctttttaaccgtagtattcagacatatgcattctctcacattctaaaaagttttctgcaaatattttaaagatgacataatattccatcattttcatcatatggttatctgcatcataacttatcaattatcctaatcctttaaattgattgtaaaatgaaatgaaaaaatagtaaaattaatatttagtacactgtactttaaaatatcagaaacactgagaattaaagtgtcttatttctttgttacgcagccaaaagacacatgaaaaaatgctcatcatcactggccatcagagaaatgcaaatcaaaaccacaatgagatatcatctcacaccagttagaatggcaatcattaaaaagccaggaaacaacaggtgctggagaggatgtggagaaataggaacacctttacactgttggtgggactgtaaactagttcaactattgtggaagtcagtgtggcaattcctcagggatctagaactagaaataccatttgacccagccattgcattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcactctcagtaaactatcgcaaggacaaaaaaccaaacaccgcatattctcactcacagatgggaactgaacaatgagaacacatggacacaggaaggggaacatcacactctggggactgttgtggggtggggggaggggggagggatagcattaggagatatacctaatgctaaatgacaagttaatgggtgcagcacaccagcatggcacaggtatacatatgtaactaacctgcacattgtgcacatgtaccctaaaacttaaagtataataaaaaaaattcatttaataaaaaaatgtagttataacaagcagtataattataactgacagtaagacagtttttagggtcttaaaatttttagccaggttcggtggctcacacctgtaatcccagcattttggtaggccgaagtgggtggatcacgaggtcaggagttcgagaccagcctggccaatgtggtgaaaccccgtctctactaaaaatacaaaaattagccgggcatggtggcgtgtgcctgtagtcccagctactcaggaggctgaggcagaagaattgcttgaacccaggaggcggaggttgcagtgagtcaagatcaagccactgtactccagcctgggcgacagagcaagactctgtctcaaaaaaaaaaaaaaaaaatttaaaggtcacagaaatatcgtaattgtcccccattgattattaagataattttgtacagtttcagcttgcaaggtcatttttttaatcttacacttcatacaaaggaaggactacctatacatagtttaattttgtttgcttcag

SEQ ID NO: 209 - DNA, 1568 bp, Homo sapiens
aaacatttgcccaattttaaattacaggccaaattaggctaactaaatccatgtcctcttattactgtgattctgaggtcatattacaaagctctgcccttcccatacccaagggtagacgtgggcatggtttttattcctgtggtacactgcacagagctccctcaaagggcaccaggcagggctggtgaaccaatgccattgaatgatctgtagtatgagatattggaggcattacatataaaccttatgaacttcacttttgccattgaatgatctgtagtatgagatattggaggcattacatataaaccttatgaatttcacttttttgagacatatgatgcacataggatcactatgtgatcctagttcacaccactgcactccagcttggtgacagagccagactgactctcaaaaaataattaaaaataaaaataaaagttagttatgtttgttttttattaattggctgagttatttgatattgtcagttgctaacatagtaaaagcataaagtcagaataaattaattttgtacacagagatgaagcagatgtcatttaaaacccgggtaagccatcatccttggaaagaccaccttctggggtatggctcatgttgctacaccagagccttggctactgtagtggttcttaacctttattgagtgtcaaagtcatctggagggccggttaaacctagctgggagtcactctccaccaccctttcaggagagtttctaacagtaggtctggggcaggccctgagaattagcatttttaacaagtttccaggtaatgctgaagttactagtgtagggactgtcctttgagaacccctggtctggtgtttccttttggcgagcaaccaagatatgggctctcaaccaccgttcgtaactgctgtgagaatgtgaacgtgaacacagagaaggaaaaccatgcctatatcattggtattgtcatttgataagtcaaatcattgctttgtaccaagccaggtttcaaatagcattgaaaatttccaaagtattgtccaaggcctttgactagaacaatagctttataaaccagtgtcatctacatagccagaaataaaattatacttaaatacaattcaactctgatgaggctttcttaaaagtctggctacagaattatggcacaggataaacgtaactggggaaaaaatatcacagtaacactatttagacatcctttattttgcccaggaatgcctttcacaagtgtattgctcctcagatcattagtaccaagcattaagatataccaaatgagatactttgtgtctcttgacgtggatatttggctgactttcaagctttgatgtaatcatatattaagtacacagtggacagctgttgtcataaagagctaaatgaaaaagcaattaagaaaaaagtttcccacaccaaaacaactcccttgattgaaattttgctgagaatcaagtagatttaaaaatatacataatgatatatatcatttttatctattttggtttgttgataagctaagtagcagcaaataactctttgattt

SEQ ID NO: 210 - DNA, 2676 bp, Homo sapiens
ttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagat

SEQ ID NO: 211 - DNA, 4656 bp, Homo sapiens
acaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaaga

SEQ ID NO: 212 - DNA, 8504 bp, Homo sapiens
ctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaaga

SEQ ID NO: 213 - DNA, 31090 bp, Homo sapiens
gaaaatgatgaacagcaaagccttgttatgatcctgatccaatttgcttttgacagattatacatctttgaaaaaaatgtgatcagtgccaccaaggtcacaacactcaccaaatgtcatcaaggtcagcagaaatacagattattccactatatcttcactacttgaggtcattttggcaatccccaaagagatcagaagtctgaaaaataggtgtctattccttgcctgggagcactcctgctatgtccagcaaacaacaggcacttgataagtatttgttacctgacttaatgacttctttcactttgatttaccttcagagaaaaaaggacttaaatgatttcttgaaactgaaatgaaaatgagtatcagtaaaagcggtaagacatgagtacagacacatgtgggtttactcaccttatctcaaagttgcaatcgcatatggctttcctgtgactttttctatcccatcacacgtgttgctacacccatttttctgtcaacccttgagtatccctgcctcctttctctgcactcaagacacacacagtcatatatctcaccctaataatacgctaaatgtttctttcttaaactttggtcacagaggggtcaagattccttttttttatatccagctccttttcccagcaataggttaaacttgctaccctatagtctgcccaggacttgattacatattagcctatttaaaagtctgcttccagaattcccctgcataaagtcttcttttggggtggacatagtctcagttcagagtctctgagctgtttctcttttttttttgccttttatagtctctcactaaatctctcttattattgcctgttcaataatcttctgttttctccacctactctttttctaaaaactttttggtttctttacaattaaggattcatgaccttatatcccaccccaagtagtgtgcacatcttgtttatacactatttatactaacatcaggacaaaatttagcacatttaaaatcaaatgacatatttgtttttagtttacttttggttgctgtgagttactcctaatccacacatatactgccacaaaaaaagaaaggaaatggctgtgcaaataatgcctgcaaaatgagccatttggcttcaagattatagccaaattatgcgacagcttgcaatagtgaattagatgagaaattgttttcagtatttacaacattttgtagcaaaagaaaaagatgtttagttctagatttgcaacgaagccactgaagcccgtttcacaatcatttacactttttggatctcagtttccaaaaatgctaaaactgagttcaacagtcactggctttgagtactttcttatggaatcaaccacttagagactacagaaaagacaagatgtaagttacccttttatgaaggaaatgtgctttcataggaacggcacaggttttagagcctaacttcccagggctagatctcctttataccctctaccagatgatctagagtgaagttacttaacttctttcagtcttgattctgcatctgtaagacagtaataataatatttgcttcacagaatttttctgaggattgcctgaacaatcctaagaatatataaatagcacgacacagtaaggtgctcaaataaatggtagttattcttaaagctgttgttctacttattgatttaaagaagggacagtattttgacttggtgacttgaaggaggatccagtgctataaaaaatttagtgtctgctagattattttaaaatgtcaaacacagagtgtttaaagggaaagggaaaattcccctcactttccttccagttccagtgtccatgtacacatctgttcaaattttttctatatgtgaaataaaagtacataaatataattgattttatcaaaaacagttcatgttacatatgctgttagataaaaatatttgggtggtaagtggaaaggaacaataaatattttcttggttcaataagaaaatattaggtctgaaggaaaaaaattagctgtgaccaaagtggaaagaaggcatctgcatgccactgcaattctttttacagaaattctctaggtgttaattttattagacattaatcacaatattttaaaataaataattaaagctttactggtaaaatcattacttaaatattcatgttggttgggtgaaataaaatcacatatacattgcctaatttgcatgaagtttgatgggtgtgtagatcacaaatgaataagaatgtaactctctcctggatgctactagatctttttctgcagagctacttacttgcagcagcctaaggaggttttgcaaacacagaggatggttggaaaaggatacagattctccacagttatttgttactccaagtgcaaactgacctagttatggttaccatggatactataattttgaatttaatcatattctgaaaaggagtagcaatacagctctatgaaacactgagatcaatctgaagctcagccttaaaaggtgaagaaactgagtcagggagggtaagtggtttatcctatatcaagagagaaattggaagattcacagaaaaatctcaaattttataaagctaagttctatgattagttcagtagccaatgtacttttcaaagtcactcaagccataaaaaatgcttcttagcttaattgatttacatgagactttgctgcacttattaaaaatacactttttctcctagtcatctataactactgtttttcaacttgaagttaaaaaagcacaaatatatatttggagtcaatataccaagctgtcatgatgaacaggtttctgcacaaatgaaaaccaagtgaaataaaaatgaaaatgcctgggaagtggaagaacaaaggatcatttgttttaacttgagcttctaggatcatttgatggccatattttatgagtctgcaacatataatcctgcatataaaacatgatattactataacatgtacatttaaacattcaaccataatattaagattttcttttaaataaatatttctgaattcaaatacttagaataaaagaaacaggaagctggctgcttataattaaaataaaatttacctgtagttctgtctcaaaagtgatctaaaatcaagtaggtgcaaattttaggacataaagatgagagaaattatacagaaggagcaaaagaattaattctgaattctccctggaaaataagaatagttcatctcctgtattggttgctttaatacaagttgctgttctgctgagtaactcttaaatggattctctaagatcataaactattggaaattgaagccagtgatctgacttagaccctggcaacattatataagcagttttcaaagattccagtggtatcttttcttgcttatgtagctggttttgatcatagccaggccacctcatgcacttgcaaagattcttccccttccctatataaatttccccccaacaaccttgaaaatcttgtaatggatgattcattacagctgagacaaaggcccaagtactatcatatgtcattgctaaaattacttcagtcaagaggatgaaaacattagaaggtttacctcctttcaatcctcagctcccatccattgttggctgacaggattattatgctgctgcttggtcagtgcattagcagaaattgttgctttcaggaagcacagcagtgaatataaaaacagagctacaagatagcagggccagtatgaacaatttatagttgaatagagagctctcaaagctggctttatggtcgtctcacaaatacattaatgatctcatctttgaggaaataatattccctgaatttctctttgcttccaaatctatattttttctttccaggagagagggtactgatcatagagaggggaaaaaaaattagcagcttgcatctaagcctctccccatacattggtaggctgcacatgatcttaagctgctatgcctgacttccaacaacagcaaacatttattgatctcatattgctagtcatgataagagtttcaaaggcaaattccttgaagaactcataatgtaactagagtcacataatgtacagagctccctctactatgatggaggtatgctgatttgtgatttcagaagagggagggagtgattgtgctcaaggagcaggagggaaatgtcacagaggaggggacattaagttgtatcatgaaaggtgtgtcatatttcatgaggatagagaaggcaatttcatgtataataaacagcttaaacaaaatcaatccccaaagaaaatagaatacatggtatgtaatgactatgtgagtgtattaatcagggttctctagagggacagaactaataggagatatatatatatacatagctcatatatatatgagttcgacgttcaagggcaggaagtacccagcatggcagaaagatgtaggctgggaggctaggccagtcttgccttttcacgtttttctgcctgctttatattctagctgcgctagcagctgatcaggtggtgcccacccagactaagtgtgggtctacctttcccagcccctagactaaaacattaatctcctttagccacaccctcacagacacacccaggatcaatacctttgtatcctcaatccaatcaagttgacattcagtattaaccatcacagtgagtcagaatgcatttttccaaatagccacagcaatttctcccattccatatgctcttcttataatgtgactttgatactcctctcattgagaagagagattctgtgctcattgagaaagtaggctttgcaacaacagtggaagtaatgctatgtgacttcatagaataggtcataaagatgatagattttctgcctggctctcataggaaaaccctttggaaacttgagctaccatatcaatgtctgacttccctcaagctgctatgcagggaaagaaacccaaactaggtcccatggagagatcaaaaggaaaggccctgaaactatcaagagaggaggatgcctgatcaacccatagctgtcctagctacttgccattttagcttcagccaatatctgccaacaaccacatgaaagatctgagttagaactacttagctgagcctttcccaaattcctggcccacagaaactgtgagagctaatacaatgataagcattgttttaagcaactaagtgctggaagtgatttgttattcagcaattaaaactagaacagtaagcaactggaaatgaaattagacagtctaattgaggcctacataatatttggattttctcctacatgaatgggaaacaatccaataagcttttttaatctgaagaatgacacgatccaatttatagtttaaaaggacactcaagagacattaggcaagatgaacaggagtagagagacactggagacaaggagaatgcttgcaggaattctcaaagttgaactgtgcataaaaatcacttgaggtgtcataaaatttcacatcccttgaactcatcccaaaaaataaaggaaaggtaatgaggaattgtttctagatacctttagtggagaaaagtacatttgttgtatgcttgctgtatgtcgggcagtttgctaggcacttggtatacagcagagtggctaagatcacagactttcctgtaagaggggcctgaatttgagttactccatcatttactagctatttgatcttgggaaaattatttaacttccctgaaactgttcccatattttaaaaatataaatattatcctacctttctcactattttacttaggtataatccttacatatagtaattgcccaataataataaatgactgcataaaaacacatgcacacatatgttcattgcagcactattcacaatagcaaagacatggaatcaacctagatgcccatcagtggtagattggagaaagtaaatgaggtacatatgcaccatggaatactatgcagccacaaagaaaagaatgagattatgtcctttgcagcaatatggatgcggctggaggccatattcctaagtgaactaacacagaaacagaaaaccaaatactgcatgttcttacttataagtgagagttaaacactgagtacacatggatgcaaagaagggaacagcaggcactggggcctagttgagtgttttggatgggaggagggtgaggattgaaaaactacctctagggtactatgcttataacctgggtgatgaaataatctgtacatcaaacccacataacatgcaatttacctataaaacaaacctgctcatgtacctcctgaaactaaaataagagaaataataataataaatgattgcaaatgttctcagcagtgttattcccacgtttcaatgttcttatctcctttagcaaaattccttctattcctgctttttcctctacatattaccaaaactcctttggaaaaacttataaataatcaacattgtgtcaaattaaaaggaattattttcatttcatttggtttcctggcaggctatcctttcattttggaaaaacttgcttctagacttctatgatgccacattccactgtttttctcctacctcaatggttgctctcctactttctttgatgcattttcctccaaaaccattctaaactcagagtccttcagggtttgattttgatccttttcctcttcacatattttcttcttaaatgacctcatcaatctatgacttaacataacatgtatattttgatgactccagtttttatctaaaatctaaatagtgactctaaattcataaatctgaaggctacttgacatttctcttttatctcttataagcatcttaacactaatgtatcctaaattgaattcttgataatctcaccaaacttactcttcctctgtgctttttccctcctataatagtgcacagcacaaaatatcttcccagttattcaatctaaaacctagaattcatctttcattcaattttttactcatccacttaaatcaaatcatctacaggttgtgtcagttcaactcttaaaaggtatttcgaattcatcaacttttcttcattcctattcctactattgtagtccaagcatttcttgcctggactgctacaataagctcctaactttttctctttccttcctccaatttagtttattcatgacatcattcaagagatgtgacttctgttttggaattatgagtgttataatctagaatcaccttggattatttcagaatcctgagatcacataatgctagacgtgaagagatttatgtatcaagtaatccacatccaacattaataagaatagtttaggttatgctaagtctaggtaataaaaaaagccccaaatctcagtagactaaagcaacaaaggattctttcatgatcaaactatacaatcatcatggggtgtctgggggttttgttctgagtcatctacattccaggactcatcctgatggagcagccactgcctggaatcttgccagtaccaagaatgacagaaaaacagctatagcaaaaacacccactgtgttattaaaacattcgctaaaagtgacatccttcacattcaatcaatttctttggccaaggcaagttgcttggccaagtctaaatcaaaaaggtgtagggaagtgaaatacctccatgtgcctaaagagagaactgaaaatattcagtgaatagcactaatgatgaattctcccttatattttacaaatgaagaaattgggacctagggagactatgtgaaccgtaagatcaagaagctgatttacatcacagtcaagactaaaactgagtcttgaactcactgtccagtgcttttcctaataatgaaccgggaattgtttgttccttattcaagcaaaatacatttaaatgtcttaatatcaatattttatttatttaagtaatatcaaccttctgtattaaagcatttttatacctttgcttagaggccttgcttctccagtctcattgatgctctagaaagatgccccagtgttaaagcactcaaaatctctttgacctggctgttctcatttctagcaaaactaagtcattaagtcatgttttatgctagggattctaaacacactggcttaagaaatgtcaaggagataagcaagagaactgtgaatctgtatgtaaattaagcaccatctgttaaatccactagaactgtattcgcaacaagaactccaattaacaatagcttagggaggggagatttatttgaccctcataacaagtctaaaggtgaatgactactgatgttggttccataggtcaatggtatcagagcccatggatctcttggtcttttctcatggacacaggagggctgtgactgctccgtgcattacccctgtgatcagtctagaagaagggggaaggttgaagccagatgagactgccccttttattggagaaccaaaagctttcccaggatcaataatccaccccttattctttcagactattataaaggtcctatttgccaggaccggggttacatggccaaccctaagagaaagggagatagaaaaaaaataggaaaaaagattatcgttgattggctaagactaatgctgccttgaacaagagaagggttctgttggcaaagaatagcatgggggtaggaggcggtaaaaatgaagaccaagtaagcaaccaacagtgtctgcctgattccctgattgaatagaagattgttctgagagaatttatctatcattcttaaattttacattcaaaataatgtgaataaataaaatatgtatttaccactgaactcatagtagctgttatgtatcttaataactggtgaaaataaaaaacatagtcaggtgctgtataatgatgtttcagtcaaagatggactacatatacaatagtggtctcataatattataataccatacttttactgtacttttctatgtttaaatacgtttagagatacaaatacttaccattgcattacaatagcctatggtactcagtacagtaacaggtttatagcccaggagcaataggcggtaccatatagcctagacatgtagtaggctataccatttaggtgtgcgtaaatgcatttcatgatgttcacacaatgacaaaattgcctaataatgctttcctcagaatgtatccttgttgttaaacaatacaggatggtataatgaagctacgtttaaagaaaatatattccataatgttcacacaatgacaaaattgtctaatgatgcttttcttagaatgtatccttgttgttaaacaatacagggttgtataatgaagctattacaataagttctgctataacacttgttttgaaaatacaaatttgttccaacaagattgacatattagggaattgtttgaacataacacaatttcgcatttgtttgtgtgtgattttgtctacttgaaacactagtcgaatgcagaaaactacccagatgacctgagccacataagaatacacaaaactcacacaggtacaatcctcaaaccttaccagtgacctcagttcactgcctgagttatgagccacacccatccacatctggtgtaataaatttcccccgatttcaaataatgcttcttctgccatttcacaacccttaagctgtgacctttctgaggcccatttccacaagcaaatgccgtgtctttttcaagataaagggttatatttgctgtagtatttatgcatttcttaagcatttatcatgtgtaaattcttgctaccatttttattaggtcttgatctgatttttatggtccattgacaaagtttctgagtgctctgtcctaaacctcatgttacccattaagtcctgtagttttaattgaactttttttttcagtgataccgtatctaaataaatccctggtggttaccaggtgaatataaataagtgtgtatatgcatacatacattcatacatatataatattcgaacacaattgaggcattttgacataaatccaaaaaattccttttatattttagaggtaaataagcctttaaaagtatttattaaatgtacttgggaggatttattcaaaaaagactatcaattatattaaataaaagccattcaatacgccaagctatatatagatgtctccatagtgggtgaagatgtgtcatttatcttttaagataattatgcaaactatattgagcacacacatcctgagctgggaaatgacttttacatctttctcctcatttataaatcttttccaacagaagttatgcaagattcagactggtcagcacagagctggattttggtggtccctttacaataggagagaatccattttcctccttagggtctttcttttctttaacgaaggcatacagagcactcagcacattcccagagcttcttagaatttttcccttgagagatctcaggaaatatgaggaaaaacaacttcaaaaaaattaatgaaaggcctatcactgtctgcctttctctcttttaatccctgccctatcctttctactttctagaagtgtagtgccccttcagtttcaaacatttttcctctccttaaattcccaaggtgggatgcccttttctggcactccgtctatgaaagggacagggaaaagatcttatagaaactgaaccctgacacggggcttattttcctaaggaccaaaacataaaaggacagggtgggaccatggaaggattaatttcaggcaagggcagcctgtggagagtgagaaatctgaaaaggctctaggcttctatgggcattcccctccacttcttctgcctgctgccagatgactctcacatgtgaatccttatttcctcaggaatgcggatcagggtttggcaagtatgttttcagtaaataattgctgaatgttcaacgcttaaaggcagaagcataactttgagtgtgcacagtaatcactgaaaatgattctgtactcaccgttttgatgcaaatgcaaattctcatagcccctgcactgactccgtgggtcacctgtgagtaactctagccaaaagccacgcacaagccctggtctgcctccaggcagcagaccacaacacagtgccctgagtgcacctgcacacacccatgggcacacattaaacccataaacggcgggttatgctaacgtgtacttccttcctcactgcctcaccttgttcattttcctttttccccacccctcaccccatacaataggatttttgtttgcttcagtagcatgtgacagcacagtccctgctttgcctagctctgtgctgcaagtctctcaggtaacaggtggcagcttcccctgttggattctaggtttaaaaaagaatgacctcatgtgggtggagctctgggacttcgtagaggtggtggcagtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttctttttttt

SEQ ID NO: 214 - DNA, 44992 bp, Homo sapiens
gtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttcactattagcccctttcttcttaataatcattttcttctgatattatttatatgtataaatgtgggtatgtgtttggattgattcttttaaatggaattggtatctttctgaatatgcagtttcctatcacatgaagcttaaagccaaaatcactaccatactccacatcttacccagtggctctcttacagactctcacttgtaagtagtatccactgtcaaataattttgattagaccaggaattaaacaaccacagagagctgtggtgtataagtcaatgtacacccgtctgatcctgtagcacacctcccccgtttactctgtgtgataggggaaagagggatccccaacggggatggggatggggatcctaacgtggtacaagaggtttttagctgcactaaattgaaatcatgatactactctggaggaggcgtttcccggctagaattgggtctgaaagtgagtttaaaatgagcccagtgaattttttttttaaataaataaaatttcaactttattgccgtctactggtcattaaattactgcagttttaaaccattcttcatgctatggaaaagaattcaagtcaccaaatcttaagcatttatttagtgtttgtgctgtgtcaagcgtagttctgggggctaagtatacaaaagtaaataagacttagattctgccctaaggaactcaatatgatcagttaagtcttaaatataagatgtaatgagcaagtagctctagttaattatttctattttcagtttaggttcagtgttagtatatcaattcagagaaacattcaaatttgaagttgtgttcattttaataaattcatatattagaagcacagtcctctaaatgttcagctgttttattctttgggaaaaaaaaggaaatggtgttatcctgggtttgaatgaacacctttcctaccttaaacaagtggcaagatctgatccaataaaagctggagccattttccttcttcgggttctagaactaagcgtgagaaatgtcacagaaagtgaacatttagcacctttgatcaaaccccacccaatgccagccctggggatggaggtccttgcctgaaaagaatgtggtgcctctactttaggcatgcgcttctaactgttcaccagaagtggagcagtctgttcagagaggaaagaacatcagtttactattcattaaacttttaacttttaagagaaagaaacagaccctgccagaagattccactaggcagtatagcccagtatcatatccccacaaagcagctaaaggcagaggtgattttagaacctcatgaagtctcagttactgaaaattattttcagacccaatggcttatttggtctttttctgcaagtttcaggtaattcccctggccatgccccaaattttgagtttagagctattctgattttaggtaacagttgcaggcactggaaggtgttaaggtttagaaagcaaaaaagccaaaagaagcagtattggcacaactatttcttaagggaaagaaaatcaaataaaatagctgaagttagagctattttcccaaaagttgcctttccatgaaaataaagttaatgatggattgtactggtctgcctgaaggctgagggcagtagaattattgacattactataatactgacctcaatcgagctaacctttaaattctgagaaacaggttttcaaacaggtttataggccaaagagagtctggaacaccctaagggcttggttttcctggccaagtaatcagtcaaagctattactgtcactctgccttttccttgtggctagataacacagcccaagtgcagttgccaatttctaatgaatactaggtgtggcctccattttatcctgtgcaaggggatattggaaatctttgttcgaagcaatatccacgagagaggtggcttcatgcctcagaagttaaggtggattttaaagcaatttaggctgctttttaaccaaaattacagtatgtttattgagggcctaataaatatttaataagagtgctaaataatgttgaaaatattttttaaaaatatataagcatagttcttgcctctcaggaacacaaaccctagttgaggagataaacaaaaccatgtggaaagtttaataacaatacaagaattaatttaaataacaccagaagctttcacagtggctgcagttcaagactaattcccaaaagagtagtagagatattacctggttctgtaaaagacccaagtttctaactttcaattattctttgaagccaattatctttcaaaagagagaataatgttgaatcctttcataacgtgagggcagtgtttttctgtgtggagttcccttgcgccagatccaccaggatggtgtattaaaagtacagattcctatgctctgcctcagaccaaaaaaaaatactatttctggtggtccagttcagggtctgctcttttaacaagccacctcaggtgattttccatacacactcaagttaagaactaaattagtgggagaaatcatacttgctgctttccctgaagcaggtgggttttttcatcaatatagatacaatctaagcagtaactacagagtttggagaccttcaaaaagaaaagattctaaggctctccaaaagcaaatacacatctgcatctatagcctacaaattggaaattagcaagtttttatttattcaacaaaaagttttgacagtcaaattagtgacccctaagattgtgtgaaatactgtattaaaatagtctccaaagttatggaagttatttgctaaagatcttattacttagccttcttggggttatttaaggtttctgatctgtatgaggaatgtgaaagatagcgtggctataaatgcaaatgtagctataattagaatagcctgtctgttgcctcctttttctgcttttccatttataaataccactaaagtccctgctgcatttcagaggccccagagatctgtttattttgtaatagaaagagaatgaaggggattttctaagtttttgatggatggaagacacatttctagcttcatgtctagttgttataaatgtatctgtatttttcttcttgctaatcaaggccatcatccccaggaggaaaacttctaacttctagtcatctgggcactttggctgctcacattactcctggagcttctccattcagggaggaagctaaaagctcatgcaatgcaaaatccaaaggaatacatttcaatttgttcaccacattttatactcattattctaatggagtgttccaagtaaaaattaaaatcacttttggaaagcccttcagttccttgttatatggcatcatgtttgaacaaagactataatccttaaggaatagtcacataaaaacttgttaattgtgagtcaaagtataatgtgttcatgagggtaggaggtatagtgataaatatattaaattactttatcccataaaagggtaaatggacacattttaaattcttccttcctgaattgcccttggttgggattagcttctgcaaagtttcagcctaaaagagatttttttaaaaatgatgaacaaataaaaagatgttataatatagtgccactactccacagattgttgttttatcctactggaaaatctctcagattccctttcataaagcgttatactacataaacacaatgtttaatttatgttatgatatttaggttttacttggctaaaataaatgaaatagaaaaaaaaaccccatgttttctgtaggagttaaaagaataaccttctctttcaacttcaatgtatgtgttttgattcctaaatgatcacattattcacttattggtttgcatgaaaaattgcatttttatttttattcattttcttccccagattttctgacctatgacgcacaaagcatatctggcaaataaaatttccctttagaagaggaaagaaggaagcatgtgagcttaaaggaaatgattggaaggaaatattgggcaggaggtggtggtggtatttctttcattgcaataggagagttctttaaacagtcgtgaataattgcctaaaattatagcagctgctgattttaaaaaaattataattctgtgcttgattcccatctaataggtcttagactaagcaaaacctagttatgttaggatgtctagcaattcactcatatagcatgtctggagattgaggaaacaattgcttcacacatgtcccccaccattttccacatatacaaagtactgagattaatggaaaaaaacttattaaatccattaaattttacaaaatgcagcttaggcacttattaaatttttcctcaatcactgaatgtaaaaagaccatctattattatggaatggatcttaaaatttttttatattgaaaacatttattgtactccaaatggttggaaaccaaagcccacagtgatcagataataaacacaggatattattttatttatccatagccacttgaggcttttagataaaaactttcatcttctttatttgttagggacatgattataaaataatgagactacttctataaggcattcatgaaaattacttattttattttacataagaaaatttaaaaggatttataatgtttgtatattaccttaaatatacagatttacatgaatttactttctttttcttctcttacaggaaaatatacatgcaagagtaagtactttttaaaataatataaatcaaatataaaaatcacgagaaaatgcagctgactgttcctgtccaaatcagaaattctgatttttctaatcatgagtattgcttttaataatccaggattgcaaaggcatttaccccattactggtgcatattttacttattaaattattatcacatatactttaccaaaccttttagaagaatcccaacatataatttactaagtttgctgatgccagaaagtctttgggaactgctcatcatacatatgtttgggaatcttaatgtgtccaaaaacacttctttctatgaaacatattagtctttaaaaaatctcagattaatatcataatgcatttgaagtttctatagattaatgcataagaaaagattattttatgaaaatattagatttcttctaatttcaagtcttgtatgatttatggagaaaaaaatcatacacattatagcatgaaaatgaaatattaaggtgaaatagttggttactaggacaatatagaaattattttagaaaaacagcgtatacaaacactctgaaagaggtccattattctagaagaaaatgtatccaggctgattaatgctgaaaggatgaaattgacttcaatacaaactccaatttatttaccaggcacatgtttggcttatgatgagcaactctttaaggtcccaagcttctagtgtgtgtttgcttgtgtgtgtgtatgtactttaaattcctaagagtttatatgaagaaataaagagcttacaaaatataaattatattaatgtaagcagcaaatatctgtcattcatattttggtgcagagcaacagtgagaacggaattctggaactgaagtgaaggagtcaggcatcatacagatctgtagaccagggctgtatatctcagtcaagttgagaagctgatttttgagacaccagacaggcaaccagttctctcactttatcagtcttttcttttcttttcctttcttttttcaaaaggaaaaactatccgacagtataaacagatatgagtagatttgtcttatgagtttccaattctaggctcatttgaattcaaagaggtgcatcggcctcctggcttctcttcaaagatagttgatgggggctgggaaatggctctgcctcattatacagcctgtgtccctggcattgtgccaaggactggagctttgcataactgagtggttagagaggaacttcatgtgctacaaattctgcttaggtttccttttctaaagcttgcattaggtctttggaaccaagaaacaagaagagaggagagagagattcagaggagaaaaagggagatattcttcttagtacaatttgcatgcacggacttctacatacagaatacttaaacagttcattgtattgaaacacgcttaaaaatggccctagcacttgctgcaatcctgctgtgtaggagttagccaggttgtgtctgctccctctagactattctatacatcaagaactaaaaaagaagagcaatcccagcatgtggctggatgcacatcaaagccaagtctgccatgaattattttccttcctgttcctttcattcaggtcatgaagcacacatactgctacaggaaagggcaaaaggcaatgtcaagtgctgtgtaattgttgggttctttagtggcaaaggccagcaatgttgcagccaaaagggcatttaagagtacaaga

SEQ ID NO: 215 - DNA, 1058 bp, Homo sapiens
aaaaggtgcttataagcgtcttttagcattttcacagaagtctccttctactgcctttaataaaatctgtttcctcccaagcttcaattttcaacattaaaaaaaaaattcttcatttgtcctatattgcagacacttcaacttttttcttgaatttttatttgtttcttgtgctacttcctaacttgggccatttaaaaacctacagtttcataattctatttttataatttttttttttttgagaaggtgtctcactctgtcaccgacgctggagtgcagtggtgcaatcatggctcactgcagcctcaatgtccaagctcaagtgatcctcccaccttagcctccctcgtagctgggaccacagctgcatgccaccatgcctggctaattttttttactatttgtagagacagggttttgctatgttgctcaagctggtcttgaactcctggactcaactgatcctcttgccttggtgtcccaaagtgctgggattataggcgtgaaccactgtgcctggcctttcatacattaagtgaggtttggggcagggcacagtggctcatgcctgtaatctcagtgctttgggaggccaaggcaggaggatcgtttgaggtcaggagttcgagacctgcctgggtaatatagcaagacactcatctgtattatatatatgttatttttttaactgggcatggtggcatgtgcctgtagttctagctactctggaggctaaggcatgaagattgctgaagcctaggaattcgaggttgcagtgagcaccgatcacaccactgcactccagtctgggtgacagagcaagaccttgtctttaaaaaaaaccaaaataataacaaaaaaaactttgtttttaagcagtgaaacctgtttttcaaatcgtatcttacaaagaacttaaatatgtatcgtaaacataggagggattctctgactgaaacaagggttggggtctaccaattatatattgttatgaacctctatgtccttagtcttttttctttcttttttttttttttttttttttactaactata

SEQ ID NO: 216 - DNA, 4301 bp, Homo sapiens
ggaaatatctgaaatattaaaatgagattttaaaaatcagtggtgaccctccccctctcacactgtcaatggagactgtgtacgttccaggaacctggactggcactgggggaatgatgtgtcctttcccctccttacaggagcagtgtcagcggaggcctactagttaggactttcaccaccaccttgcagtaccaaggccacccccctgcagtgtcagtagagactgtactcagagcagtaagaatccccacctctcccagagtgggggtatcatgggaaggctggtaaggagcctgaactcctgcccctgccaagcaataatgaggtatgcctacccaccagatgccaacaaagacttagtgggtaacccagacatccaaccccattgaacaagtaaagaggtagagcagtatcagacgacatctactagacagaaggtctcaaaaagatccatccaaaatttcatgaaataatagccaaagtgtctaaaatttgatgaaaaatgacttgtcataccaagaaccagaagcacctcaacttgaataagaaaagacagtcagcagggcttcgtggctcactcctgtaatcccagcactttgggaggctcaggtggccgggaggtcaggagttcaagaccagcctggccaacatggtgaaacctggtctctaataaaaattaaaagaaaaaaaaattagctggctgtggtggctggcacctgtagtcccagctactcaagaggctgaggcaggagaatcgcttgaatccaggaggcagaggttgcagtgagccgagatagcaccattgcactccagcctgggtgacagagtgaaactccgtctcaaaaaaaagaaaagacagtcaagagacactaacaccaagacacagatatcagaattttctgacaaggatttaaaatcagccatcataaaaatggtttagggccaggcacagtggctcacgcctgtaatcccagcactttggaaggccgaggtgggcagataacctaaggtctggagttcgagaccagcctgaccaacatggagaaaccctgtctctactaaaaatacaaaattagctgggtgtggtggcacatgcctgtaatcccaggtacttgggaggctgaggcaggagaaccgcttgaacccgggaggcggagattgcagtgagctgagatcatgccattgcactccagcctgggcaacaagagtgaaactccatttcaaaaaacataaacaaaaacaaaaaagctttaatgagcaataataaagaagcataaaacaaaagaaaaaatataaaacatcagtaagtagaagatgtaaaggatcaaatataaactttagaactaaacaatacaataactgaacaatacaaaagctcagtgatggactcaataatagaagagcgaaaacaaaagaatcagcgtacctgaatttctttaacagaacaacagaaattactcaatctgaacaacaaagagaaaaagtctaaaaacaatgaacagagcctcaggaacctgtgggaccataatcgaagatttcctttgtgtcactgaagtttcagagggaaaaaagaaagagggtgtggctgaaaacttcttctaagaaacaatggctgaaaatatcccaaatttggcaaaaagacataatgattgaagaagtttacagattgaagtttagagaacctcaaacatttgaaaaacccatggaaatccatgccaagatacaacataatgaaatttctgaaaaataaagacaaagaaaaagcttcaaagcagcagggcagaaagggacacctcacctaaagaagaataaaaattaaaatgacagcagattcctccccagaaaccacggaagccagaaggaaatgatgcaacattttcaagtgctgaaagaaaagatctgtcaagacagaatctgattctcagtgaaaatatccttcagaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcgtaagtattattggggctcaggaaacaatgtcccaaagtatggtgctttggcatgctgagtgctttgaatcaaggtttctctgaccttctcctcaccctcctccagtcccctgctgcccctgtctctcatctcttgcccctctttccctcccaaagtgcaggaaggtgctttctctgaagttcccttatctgactaagggaagttcctccagaagaaatgcaattgctttgagcccccctctctataatcttatcaaacagagaagattagctcacaggaaaggagactaaaggtcaaaaccacctattctgaagattgctagctgagagactttatccgtataacaagacagcctctgctcatcacacatttttctcccctcaaacctctataacctgttaccacctcccaccagaaatcccagccccttatttctttctgtagctcaaaatgctatttaagcttccaccatcaggcccttttttgagtctcatattgtgtggggctcccgtctatatgcatgtaataaacgtgtgtgccttttctcctgttaatctgtatattgtcaactttattccagagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacacatttaaaaatattacagatatatggaaatgcaattataaacaaagttcaaataaccctcaggaaggcaggaaaaacaaaacagtgaaaggtaaagagacggttaagtcgaaaaagcaaaaaatgaaatggcagacttaagctctagactttcgaagatgggaaatacaggattgactctaaaggggtacgactttatcttgatcatggtggtgattacccaaatctacacatgtgaaaaaaaaaaaagacatggaactatatgtacacattataccgttggggctcagaaactgatacaccaaaatatggcgctttgatgtgcttaactgaagaagaagccttaggcctctctgaccttcctcctcccttccttctctcaatcctctgcgcctcccaaagcaaaagatgaagttattctctgaagttcccttatctgctgagagtctggacttgccaaagaagaaaacaatcacctctggtcccttccctgagttttcattaactgaactcatatcacaggaagaaagactgaagtctgtcaacacacctgagcaggtttttgtcacgaaccatcgtgtctgctctgctggcccaacagactttgtcctaggccggtgtatgttcttcaagcccactgaattcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgcagatttgtgaagaaaaccaaattcgtgagtaacatgta
